(12) United States Patent
Wengner et al.

(10) Patent No.: US 11,976,334 B2
(45) Date of Patent: May 7, 2024

(54) INHIBITOR OF ATR KINASE FOR USE IN A METHOD OF TREATING A HYPER-PROLIFERATIVE DISEASE

(71) Applicants: Bayer Aktiengesellschaft, Leverkusen (DE); Bayer Pharma Aktiengesellschaft, Berlin (DE)

(72) Inventors: Antje Margret Wengner, Berlin (DE); Gerhard Siemeister, Berlin (DE); Bernard Händler, Berlin (DE); Sven Golfier, Berlin (DE); Andreas Schlicker, Berlin (DE); Li Liu, East Hanover, NJ (US)

(73) Assignees: Bayer Aktiengesellschaft, Leverkusen (DE); Bayer Pharma Aktiengesellschaft, Berlin (DE)

( * ) Notice: Subject to any disclaimer, the term of this patent is extended or adjusted under 35 U.S.C. 154(b) by 68 days.

(21) Appl. No.: 17/164,336

(22) Filed: Feb. 1, 2021

(65) Prior Publication Data
US 2021/0404012 A1 Dec. 30, 2021

Related U.S. Application Data

(63) Continuation of application No. 16/488,033, filed as application No. PCT/EP2018/054361 on Feb. 22, 2018, now abandoned.

(60) Provisional application No. 62/463,125, filed on Feb. 24, 2017, provisional application No. 62/589,837, filed on Nov. 22, 2017.

(51) Int. Cl.
C12Q 1/6886 (2018.01)
A61K 31/5377 (2006.01)
A61P 35/00 (2006.01)

(52) U.S. Cl.
CPC ........ *C12Q 1/6886* (2013.01); *A61K 31/5377* (2013.01); *A61P 35/00* (2018.01); *C12Q 2600/106* (2013.01); *C12Q 2600/156* (2013.01); *C12Q 2600/158* (2013.01)

(58) Field of Classification Search
CPC .............................. A61K 31/5377; A61P 35/00
See application file for complete search history.

(56) References Cited

U.S. PATENT DOCUMENTS 9,549,932 B2 * 1/2017 Wortmann ......... A61K 31/5386

FOREIGN PATENT DOCUMENTS

| WO | 2013152298 A1 | 10/2013 | |
|---|---|---|---|
| WO | 2015118338 A1 | 8/2015 | |
| WO | WO-2016020320 A1 * | 2/2016 | ......... A61K 31/5377 |
| WO | 2016112374 A2 | 7/2016 | |
| WO | 2017118734 A1 | 7/2017 | |

OTHER PUBLICATIONS

Bussion, et al., "APOBEC3A and 3B Activities Render Cancer Cells Susceptible to ATR Inhibition", Cancer Res., 2017, 4567-4578, 77(17).

(Continued)

*Primary Examiner* — Kevin E Weddington

(57) ABSTRACT

The present invention covers 2-[(3R)-3-methylmorpholin-4-yl]-4-(1-methyl-1H-pyrazol-5-yl)-8-(1H-pyrazol-5-yl)-1,7-naphthyridine (in the following called "Compound A"), an inhibitor of ATR kinase, for use in a method of treating a hyper-proliferative disease in a subject. Preferably the hyper-proliferative disease or the subject is characterized by one or more biomarker(s) selected from a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or b) the activation of the ALT pathway; and/or c) microsatellite instability.

The present invention also covers a kit comprising Compound A together with means to detect one or more of the aforementioned biomarker(s) and a method for identifying a subject having a hyper-proliferative disease disposed to respond favorably to Compound A, wherein the method comprises the detection of one or more of the aforementioned biomarker(s). Further, the invention covers a method of determining whether a subject having a hyper-proliferative disease will respond to the treatment with Compound A, wherein the method comprises the detection of one or more of the aforementioned biomarker(s) in a sample of the subject.

6 Claims, No Drawings

Specification includes a Sequence Listing.

(56) References Cited

OTHER PUBLICATIONS

Checkley, et al., "Bridging the gap between in vitro and in vivo: Dose and schedule predictions for the ATR inhibitor AZD6738", Scientific Reports, Aug. 27, 2015.
Chris T. Williamson et al, "ATR inhibitors as a synthetic lethal therapy for tumours deficient in ARID1A", Nature Communications, (Dec. 13, 2016), vol. 7, doi:10.1038/ncomms13837, p. 13837, XP055355360.
Cottini, et al., "Synthetic Lethal Approaches Exploiting DNA Damage in Aggressive Myeloma", Cancer Discovery, Sep. 2015, 972-987.
Flynn et al., "Alternative Lengthening of Telomeres Renders Cancer Cells Hypersensitive to ATR Inhibitors.", Science, (Jan. 16, 2015), vol. 347, No. Issue 6219, pp. 273-277.
Green et al., "Cytosine Deaminase APOBEC3A Sensitizes Leukemia Cells to Inhibition of the DNA Replication Checkpoint", The Journal of Cancer Research, Jun. 2017, 1-10, 77(17).
Hocke et, al., "A synthetic lethal screen identifies ATR-inhibition as a novel therapeutic approach for POLD1-deficient cancers", Oncotarget, Jan. 2016, 7080-7095, 7(6).
Ingmar Brandsma et al; Expert Opinion Investigational Drugs; Directing the use of DDR kinase inhibitors in cancer treatment, ISSN: 1354-3784 (Print) 1744-7658 (Online); Oct. 2017.
International Search Report with Written Opinion for International Patent Application No. PCT/EP/2018/054361 mailed Sep. 6, 2019.
J. Murai et al; Resistance to PARP inhibitors by SLFN11 inactivation; Impactjournals Oncotarget, vol. 7; No. 47; 2016.
J Murai et al; Targeting DNA repair and replication stress in the treatment of Ovarian Cancer; Int J Clin Oncol (2017) 22:619-628; DOI 10.1007/s10147-017-1145-7; 2017.
Joshi, et al., "Ovarian Cancer-associated Mutations Disable Catalytic Activity of CDK12, a Kinase That Promotes Homologous Recombination Repair and Resistance to Cisplatin and Poly(ADP-ribose) Polymerase Inhibitors*", The Journal of Biological Chemistry, Mar. 28, 2014, pp. 9247-9253, 289(13).
Kim et al; ATR and PARP in BRCA Ovarian models; DOI: 10.1158/1078-0432.CCR-16-2273; 2016.
Kirsten M. Timms et al; DNA repair deficiencies in ovarian cancer; 2015.
Kwok et al., ATR inhibition induces synthetic lethality and overcomes chemoresistance is TP53- or ATM-defective chronic lymphocytic leukemia cells, Blood 4;127(5) (2016) 582-595.
Kwok et al., Synthetic lethality in chronic lymphocytic leukaemia with DNA damage response defects by targeting the ATR pathway (Lancet 26, 385, Suppl 1, (2015), S58.
M Krajewska et al; ATR inhibition preferentially targets homologous recombination-deficient tumor cells, Oncogene; 34, 3474-3481; http://dx.doi.org/10.1038/onc.2014.276; 2015.
Manic, et al., "Trial Watch: Targeting ATM-CHK2 and ATR-CHK1 pathways for anticancer therapy", Molecular & Cellular Oncology, 2015.
McNeish, et al., "HRD as a predictive biomarker for response to PARP inhibition in ovarian high grade serous ovarian carcinoma", Oct. 2016, University of Glasgow.
McNeish et,al., "Results of ARIEL2: A phase 2 trial to prospectively identify ovarian cancer patients likely to respond to rucaparib using tumor genetic analysis" 2015.
Menezes, et al., A Synthetic Lethal Screen Reveals Enhanced Sensitivity to ATR Inhibitor Treatment in Mantle Cell Lymphoma with ATM Loss-of-Function, American Association for Cancer Research, Jan. 2015, pp. 120-129, 13(1).
Middleton, F.K. et al., "Common cancer-associated imbalances in the DNA damage response confer sensitivity to single agent AT", Oncotarget, (2015), vol. 6, No. 32, doi:10.18632/oncotarget.6136, ISSN 0004582528, pp. 32396-32409, XP055412415.
Mohni, et al., A Synthetic Lethal Screen Identifies DNA Repair Pathways that Sensitize Cancer Cells to Combined ATR Inhibition and Cisplatin Treatments, PLOS One, May 12, 2015.
Mohni, et al., "ATR Pathway Inhibition Is Synthetically Lethal in Cancer Cells with ERCC1 Deficiency", American Association for Cancer Research, 2014, pp. 2835-2845, 74.
"Myriad myChoiceTM HRD Technical Specifications", Feb. 2016.
Rebeka Sultana et al., "Ataxia Telangiectasia Mutated and Rad3 Related (ATR) Protein Kinase Inhibition Is Synthetically Lethal in XRCC1 Deficient Ovarian Cancer Cells", ?PLOS|ONE?.
Ruiz, et al, "A genomewide CRISPR screen identifies CDC25A as a determinant of sensitivity to ATR inhibitors", Mol Cell. Author Manuscript, Apr. 21, 2016, pp. 307-313, 62(2).
Sundar, et al., "Targeting ATR in cancer medicine", Curr Probl Cancer, 2017, 1-9, 8(2).
Vendetti, et al., "The orally active and bioavailable ATR kinase inhibitor AZD6738 potentiates the anti-tumor effects of cisplatin to resolve ATM-deficient non-small cell lung cancer in vivo", Oncotarget, Oct. 2015, 44289-44305, 6(42).

* cited by examiner

INHIBITOR OF ATR KINASE FOR USE IN A METHOD OF TREATING A HYPER-PROLIFERATIVE DISEASE

CROSS REFERENCE TO RELATED APPLICATIONS

This application is a continuation of U.S. patent application Ser. No. 16/488,033, which adopts the international filing date of Feb. 22, 2018, which is a national stage application under 35 U.S.C. § 371 of International Application No. PCT/EP2018/054361, filed internationally on Feb. 22, 2018, which claims priority benefit of U.S. Application No. 62/463,125, filed Feb. 24, 2017, and U.S. Application No. 62/589,837, filed Nov. 22, 2017.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 777052036401SEQLIST.TXT, date recorded: Jan. 27, 2021, size: 1569 KB).

The present invention covers an inhibitor of ATR kinase, particularly of 2-[(3R)-3-methylmorpholin-4-yl]-4-(1-methyl-1H-pyrazol-5-yl)-8-(1H-pyrazol-5-yl)-1,7-naphthyridine (in the following called "Compound A"), for use in a method of treating a hyper-proliferative disease in a subject. Preferably the hyper-proliferative disease or the subject is characterized by one or more biomarker(s) selected from
a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
b) the activation of the ALT pathway; and/or
c) microsatellite instability.

BACKGROUND

The integrity of the genome of eukaryotic cells is secured by complex signalling pathways, known as DNA damage response (DDR). Recognition of DNA damage activates DDR pathways resulting in cell cycle arrest, suppression of general translation, induction of DNA repair, and, finally, in cell survival or cell death. Proteins that directly recognize aberrant DNA structures recruit and activate kinases of the DDR pathway, such as ATR. ATR responds to a broad spectrum of DNA damage, including double-strand breaks and lesions derived from interference with DNA replication as well as increased replication stress that is observed in oncogene-driven tumor cells (e.g. Ras mutation/upregulation, Myc upregulation, CyclinE overexpression).

ATR kinase inhibitors are specifically or generically disclosed in the following publications: J. Med. Chem. 2013, 56, 2125-2138; Exp. Rev. Mol. Med. 16, e10, 2014; WO2010054398A1; WO2010071837A1; WO2010073034A1; WO2011143399A1; WO2011143419A1; WO2011143422A1; WO2011143423A2; WO2011143425A2; WO2011143426A1; WO2011154737A1; WO2011163527A1; WO2012138938A1; WO2012178123A1; WO2012178124A1; WO2012178125A1; WO2013049719A1; WO2013049720A1; WO2013049722A1; WO2013049859A1; WO2013071085A1; WO2013071088A1; WO2013071090A1; WO2013071093A1; WO2013071094A1; WO2013152298A1; WO2014062604A1; WO2014089379A1; WO2014143240; WO 2014143241; WO 2014143242; ACS Med. Chem. Lett. 2015. 6, 37-41; ACS Med. Chem. Lett. 2015. 6, 42-46, WO 2015085132, WO 2015187451.

2-[(3R)-3-methylmorpholin-4-yl]-4-(1-methyl-1H-pyrazol-5-yl)-8-(1H-pyrazol-5-yl)-1,7-naphthyridine (in the following called "Compound A") is a new ATR kinase inhibitor, which together with more than 400 other ATR kinase inhibitors was described in International Patent Application WO2016020320. Identification of one or more biomarkers that predict sensitivity to Compound A could result in more effective biomarker-driven targeted therapy for hyper-proliferative diseases.

No predictive markers for ATR kinase inhibitors have been identified yet in the clinical setting. However, preclinical evidence suggests a number of candidate predictive biomarkers for ATR kinase inhibitors VE-821, VX-970 and AZD6738: Williamson et al. suggest that ATR kinase inhibitors could have potential as single-agent treatments for ARID1A defective cancers (Nature Communications 7:13837|DOI: 10.1038/ncomms13837, (2016)). According to Mohni et al. ATR pathway inhibition is synthetically lethal in VE-821 treated cancer cells with ERCC1 deficiency and loss of the structure-specific endonuclease ERCC1-XPF (ERCC4) is synthetic lethal with ATR pathway inhibitors (Cancer Res. 74, (2014), 2835-2845). Strong synthetic lethal relationships with ATR inhibition was also shown for the following genes: ATRIP, RPA, CHEK1, CLSPN, HUS1, RAD1, RAD17, TIMELESS, and TIPIN (Mohni et al., Cancer Res. 74, (2014), 2835-2845). ATR inhibition by VE-821 also seems to synergize with loss of ERCC1, ATM and XRCC1 (Mohni et al., PLOS ONE|DOI:10.1371/journal.pone.0125482 May 12, 2015; Sultana et al, PLoS One, 8(2). (2013), e57098. doi: 10.1371/journal.pone.0057098). According to Hocke et al. (Oncotarget Vol. 7, No. 6, (2016), 7080-7095) POLD1 deficiency might represent a predictive marker for treatment response towards ATR inhibitors. Flynn et al. (Science 347, (2015), 273-277) suggest that ATR kinase inhibitors may be useful for treatment of ALT-positive cancers. According to the data described by Menezes et al. (Mol. Cancer. Res. 13(1), (2015), 120-129) single-agent ATR inhibitors may have therapeutic utility in the treatment of mantle cell lymphoma with ATM loss-of-function. Middleton et al. (Oncotarget, Vol. 6, No. 32, (2015), 32396-32409) suggest that defects in ATM, BRCA2, XRCC3 and XRCC1 and high DNA-PKcs expression conferred sensitivity to VE-821 monotherapy.

According to Jones et al. (Cancer Research (2017), Author Manuscript Published OnlineFirst on Oct. 16, 2017; DOI: 10.1158/0008-5472.CAN-17-2056) in Synovial sarcoma SS18-SSX1 or SS18-SSX2 fusion proteins induce ATR kinase inhibitor sensitivity. Nieto-Soler et al. (Oncotarget. 2016; 7:58759-58767) suggest that expression of EWS-FLI1 (also called EWSR1-FLI1) or EWS-ERG (also called EWSR1-ERG oncogenic translocations sensitizes non-ES cells to ATR inhibitors.

Remi-Buisson et al. (Cancer Res 77(17), (2017), 4567-4578) describe that APOBEC3A and APOBEC3B overexpression confers susceptibility to ATR kinase inhibitors.

Kwok et al (Lancet 26, 385, Suppl 1, (2015), S58. doi: 10.1016/S0140-6736(15)60373-7; Blood 4; 127(5), (2016), 582-595. doi: 10.1182/blood-2015-05-644872) showed that AZD6738 sensitized TP53- or ATM-defective primary chronic lymphocytic leukemia (CLL) cells to chemotherapy and ibrutinib.

Ruiz et al (Mol Cell 62(2), (2016), 307-313, DOI: 10.1016/j.molcel.2016.03.006) reported that deficiency in cdc25A confers resistance to ATR inhibitors.

The object of the present invention is to provide one or more biomarker(s) for the treatment of one or more hyperproliferative disease(s) with an ATR kinase inhibitor, particularly with Compound A as described herein, in a subject.

DETAILED DESCRIPTION OF THE INVENTION

Definitions of terms used in the context of the present invention:

The term "inhibitor of ATR kinase" or the term "ATR kinase inhibitor" as used herein means any compound that inhibits ATR kinase. Examples of ATR kinase inhibitors which may be used in context with the present invention include VX-803, VX-970, AZD-6738 and preferably Compound A (described infra).

In context with the present invention the term "VX-803" means 2-amino-6-fluoro-N-[5-fluoro-4-(4-{[4-(oxetan-3-yl)piperazin-1-yl]carbonyl}piperidin-1-yl)pyridin-3-yl]pyrazolo[1,5-a]pyrimidine-3-carboxamide. VX-803 has the following structure

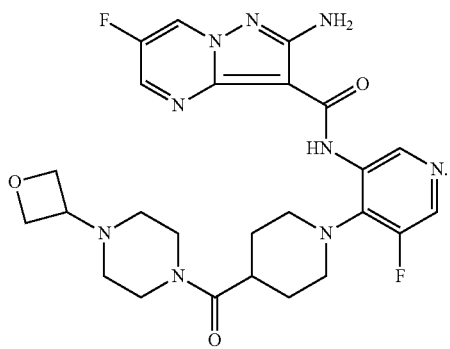 [SMILES: Nc1nn2cc(F)cnc2c1C(=O)Nc1cncc(F)c1N1CCC(C(=O)N2CCN(C3COC3)CC2)CC1]

In context with the present invention the term "VX-970" means 3-(3-{4-[(methylamino)methyl]phenyl}-1,2-oxazol-5-yl)-5-[4-(propan-2-ylsulfonyl)phenyl]pyrazin-2-amine. VX-970 has the structure

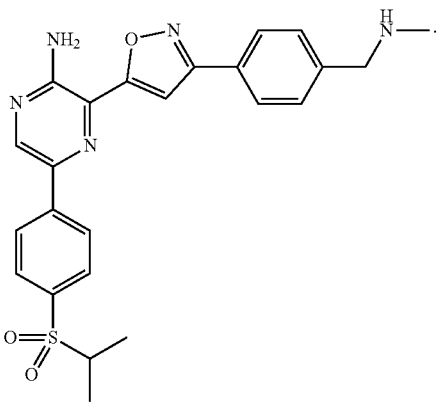 [SMILES: CNCc1ccc(-c2cc(-c3nc(-c4ccc(S(=O)(=O)C(C)C)cc4)cnc3N)on2)cc1]

In context with the present invention the term "AZD-6738" means 4-{4-[(3R)-3-methylmorpholin-4-yl]-6-[1-(S-methylsulfonimidoyl)cyclopropyl]pyrimidin-2-yl}-1H-pyrrolo[2,3-b]pyridine. AZD-6738 has the structure

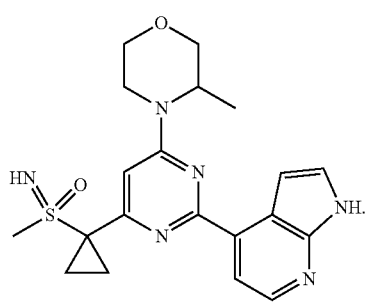 [SMILES: CC1COCCN1c1cc(C2(S(C)(=N)=O)CC2)nc(-c2ccnc3[nH]ccc23)n1]

The term "Compound A" as used herein means 2-[(3R)-3-methylmorpholin-4-yl]-4-(1-methyl-1H-pyrazol-5-yl)-8-(1H-pyrazol-5-yl)-1,7-naphthyridine of structure:

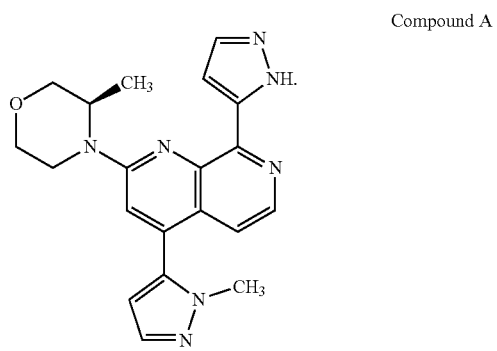 [SMILES: C[C@@H]1COCCN1c1cc(-c2ccnn2C)c2ccnc(-c3ccn[nH]3)c2n1]

Compound A

In particular, the term Compound A refers to 2-[(3R)-3-methylmorpholin-4-yl]-4-(1-methyl-1H-pyrazol-5-yl)-8-(1H-pyrazol-5-yl)-1,7-naphthyridine.

The expression "gene/protein" means one gene or one protein. The expression "gene(s)/protein(s)" means one or more gene(s) or one or more protein(s). The expression "gene(s)" means one gene or more genes. The expression "protein(s)" means one protein or more proteins.

The term "hyper-proliferative disease" includes but is not limited, e.g., psoriasis, keloids, and other hyperplasias affecting the skin, benign prostate hyperplasia (BPH), as well as malignant neoplasia. Examples of malignant neoplasia treatable with Compound A according to the present invention include solid and hematological tumors. Solid tumors can be exemplified by tumors of the breast, bladder, bone, brain, central and peripheral nervous system, colon, anum, endocrine glands (e.g. thyroid and adrenal cortex), esophagus, endometrium, germ cells, head and neck, kidney, liver, lung, larynx and hypopharynx, mesothelioma, ovary, pancreas, prostate, rectum, renal, small intestine, soft tissue, testis, stomach, skin, ureter, vagina and vulva. Malignant neoplasias include inherited cancers exemplified by Retinoblastoma and Wilms tumor. In addition, malignant neoplasias include primary tumors in said organs and corresponding secondary tumors in distant organs ("tumor metastases"). Hematological tumors can be exemplified by aggressive and indolent forms of leukemia and lymphoma, namely non-Hodgkins disease, chronic and acute myeloid leukemia (CML/AML), acute lymphoblastic leukemia (ALL), Hodgkins disease, multiple myeloma and T-cell lymphoma. Also included are myelodysplastic syndrome, plasma cell neoplasia, paraneoplastic syndromes, and cancers of unknown primary site as well as AIDS related malignancies.

Examples of breast cancer include, but are not limited to invasive ductal carcinoma, invasive lobular carcinoma, ductal carcinoma in situ, and lobular carcinoma in situ, particularly with bone metastases.

Examples of cancers of the respiratory tract include, but are not limited to small-cell and non-small-cell lung carcinoma, as well as bronchial adenoma and pleuropulmonary blastoma.

Examples of brain cancers include, but are not limited to brain stem and hypophtalmic glioma, cerebellar and cerebral astrocytoma, medulloblastoma, ependymoma, as well as neuroectodermal and pineal tumor.

Tumors of the male reproductive organs include, but are not limited to prostate and testicular cancer. Tumors of the female reproductive organs include, but are not limited to endometrial, cervical, ovarian, vaginal, and vulvar cancer, as well as sarcoma of the uterus.

Tumors of the digestive tract include, but are not limited to anal, colon, colorectal, esophageal, gallbladder, gastric, pancreatic, rectal, small-intestine, and salivary gland cancers.

Tumors of the urinary tract include, but are not limited to bladder, penile, kidney, renal pelvis, ureter, urethral and human papillary renal cancers.

Eye cancers include, but are not limited to intraocular melanoma and retinoblastoma. Examples of liver cancers include, but are not limited to hepatocellular carcinoma (liver cell carcinomas with or without fibrolamellar variant), cholangiocarcinoma (intrahepatic bile duct carcinoma), and mixed hepatocellular cholangiocarcinoma.

Skin cancers include, but are not limited to squamous cell carcinoma, Kaposi's sarcoma, malignant melanoma, Merkel cell skin cancer, and non-melanoma skin cancer. Head-and-neck cancers include, but are not limited to laryngeal, hypopharyngeal, nasopharyngeal, oropharyngeal cancer, lip and oral cavity cancer and squamous cell. Lymphomas include, but are not limited to AIDS-related lymphoma, non-Hodgkin's lymphoma, cutaneous T-cell lymphoma, Burkitt lymphoma, Hodgkin's disease, and lymphoma of the central nervous system. Sarcomas include, but are not limited to sarcoma of the soft tissue, osteosarcoma, malignant fibrous histiocytoma, lymphosarcoma, and rhabdomyosarcoma. Leukemias include, but are not limited to acute myeloid leukemia, acute lymphoblastic leukemia, chronic lymphocytic leukemia, chronic myelogenous leukemia, and hairy cell leukemia.

In particular, the present invention covers the treatment of lung cancer, colorectal cancer, cervical cancer, bladder cancer, breast cancer, melanoma, B-cell lymphoma, particularly diffuse large B-cell lymphoma (DLBCL), mantle cell lymphoma, prostate cancer, gliomas, ovarian cancer, glioblastoma, neuroblastoma, chronic lymphocytic leukemia (CLL), fibrosarcoma, gastric cancer, esophageal cancer, pancreatic cancer, chronic and acute myeloid leukemia (CML/AML), acute lymphoblastic leukemia (ALL), Hodgkins disease, multiple myeloma (MM) and T-cell lymphoma, endometrial cancer, vaginal cancer, and vulvar cancer, as well as sarcoma of the uterus.

Preferably, the present invention covers the treatment of prostate cancer, B-cell lymphoma, particularly diffuse large B-cell lymphoma (DLBCL), mantle cell lymphoma, melanoma, particularly malignant melanoma, ovarian, particularly, ovarian adenocarcinoma, colorectal cancer, lung, particularly non-small cell lung carcinoma, cervical cancer, and breast cancer, particularly triple-negative mammary carcinoma, pancreatic cancer, fibrosarcoma.

The term "functional mutation" as used herein means a mutation of a gene which results in an altered function of the gene, its corresponding RNA or its corresponding protein compared to the function of the respective wildtype gene, corresponding wildtype RNA or corresponding wildtype protein.

The term "altered function" as used herein means either reduced or increased function of the gene, its corresponding RNA or its corresponding protein compared to the function of the respective wildtype gene, corresponding wildtype RNA or corresponding wildtype protein. The term "altered function" also includes the complete loss of the function or the gain of a new function of the gene, its corresponding RNA or its corresponding protein compared to the function of the respective wildtype gene, corresponding wildtype RNA or corresponding wildtype protein.

The reference nucleotide sequences of the cDNA's of the respective wildtype genes are described in the attached sequence protocol (SEQ ID Nos 1 to 111). The reference amino acid sequences of the respective wildtype proteins are described in the attached sequence protocol (SEQ ID Nos 112 to 222).

The functional mutation can be a "deleterious mutation" or an "activating mutation".

The term "deleterious mutation" as used herein means a mutation of a gene which has a deleterious effect on the function of said gene or on the function of its corresponding RNA or its corresponding protein.

For example, the deleterious mutation of the gene may result in a reduced gene expression level of said gene, a reduced amount or a reduced activity of the protein corresponding to said gene, or it may result in a nonfunctional gene/protein ("loss-of-function") compared to the respective wildtype gene/protein.

Examples of a deleterious mutation include but are not limited to the following:

The deleterious mutation can be a nonsense mutation, which is a point mutation in the respective gene, resulting in a premature stop codon, or a nonsense codon in the transcribed mRNA, and in a truncated, incomplete, and nonfunctional protein corresponding to the respective gene.

The deleterious mutation can be a missense mutation, which is a point mutation in the respective gene, resulting in the production either of a nonfunctional protein (complete loss of function) or in a protein with partial loss of function compared to the respective wildtype protein.

The deleterious mutation can also result in a frameshift mutation, which is a genetic mutation in the respective gene caused by insertions or deletions of one or more nucleotides in such gene, wherein the number of nucleotides is not divisible by three, and resulting in a (sometimes truncated) nonfunctional protein corresponding to the respective gene.

The deleterious mutation can also be a large rearrangement mutation, for example a deletion of one or more exons disrupting the reading frame or a critical functional domain of the corresponding protein. Another example for a large rearrangement mutation is a duplication of one or more non-terminal exons disrupting the reading frame or a critical functional domain of the corresponding protein.

The deleterious mutation can also be a splice site mutation, which is a genetic mutation that inserts, deletes or changes a number of nucleotides in the specific site at which splicing takes place during the processing of precursor messenger RNA into mature messenger RNA. Splice site consensus sequences that drive exon recognition are located at the very termini of introns. The deletion of the splicing site results in one or more introns remaining in mature mRNA thereby resulting in the production of a nonfunctional protein corresponding to the respective gene.

The deleterious mutation can also be a copy number variant (CNV), particularly a decrease of the gene copy number (e.g. a homozygous or heterozygous deletion) compared to the normal gene copy number of the respective gene.

The term "activating mutation" as used herein means a mutation of a gene which changes said gene, its corresponding RNA and/or its corresponding protein in such a way, that its effects (e.g. the amount of corresponding RNA/protein, or the protein activity) get stronger compared to the respective wildtype gene/RNA/protein. The term "activating mutation" also includes a mutation of a gene, in which the protein corresponding to said gene gets a new function compared to the function of the corresponding wildtype protein. Examples of activating mutations include but are not limited to the following:

The activating mutation can be a substitution of one amino acid residue by another that confers a new or higher activity upon the protein.

The activating mutation can be a copy number variant (CNV), particularly an increase of the gene copy number compared to the normal gene copy number of the respective gene.

The activating mutation can also be a fusion gene or fusion protein, e.g. occurring as a result of translocation, interstitial deletion or chromosomal inversion.

The term "stratification method" as used herein means the method by which one or more of the functional mutation(s) as defined herein, particularly of the deleterious mutations and the activating mutations, the activation of the ALT pathway and/or the microsatellite instability is (are) determined.

Preferably, the stratification method is an in-vitro method. Examples of stratification methods, which can be used in context with the present inventions, are described infra.

The term "activation of the ALT pathway" as used herein refers to cancer cells which overcome replicative senescence by activating the Alternative Lengthening of Telomeres (ALT) pathway.

The term "microsatellite instability" ("MSI") as used herein is the expansion or reduction in the length of repetitive DNA sequences (known as microsatellites) in the DNA of a sample, e.g. a tumor sample, compared to normal cells.

MSI testing can detect an abnormal number of microsatellite repeats, which indicates that the cancer may arose from cells with defect mismatch repair genes.

A microsatellite is a tract of tandemly repeated (i.e. adjacent) DNA motifs that range in length from one to six nucleotides, and are typically repeated 5-50 times. For example, the sequence TATATATATA is a dinucleotide microsatellite, and GTCGTCGTCGTCGTC is a trinucleotide microsatellite (with A being Adenine, G Guanine, C Cytosine, and T Thymine). Repeat units of four and five nucleotides are referred to as tetra- and pentanucleotide motifs, respectively. Microsatellites are distributed throughout the genome. Many are located in non-coding parts of the human genome, however they can also be located in regulatory regions and within the coding region.

MSI tumors may result from inactivating germline mutations in one or more genes, including MLH1, MSH2, MSH6 and PMS2, and epithelial cell adhesion molecule (EPCAM), such as occurs in patients with Lynch syndrome, for whom more than 90% of colon cancers test MSI positive. MSI also occurs sporadically in several cancer types, including colorectal, endometrial, ovarian, and gastric cancers. In contrast to Lynch syndrome, sporadic MSI is often due to somatic promoter hypermethylation of MLH1 in the absence of gene sequence mutations.

The term "sample" as used herein means the sample from the subject, preferably an in vitro sample, which is used in the stratification method (as defined herein), e.g. a sample of tumor cells or of tumor tissue, a blood sample, particularly a sample of tumor tissue containing tumor cells.

ASPECTS OF THE PRESENT INVENTION

Use(s) of the Present Invention

The present invention covers an inhibitor of ATR kinase, particularly of 2-[(3R)-3-methylmorpholin-4-yl]-4-(1-methyl-1H-pyrazol-5-yl)-8-(1H-pyrazol-5-yl)-1,7-naphthyridine (in the following called "Compound A") or a tautomer, an N-oxide, a hydrate, a solvate, or a pharmaceutically acceptable salt thereof, particularly Compound A, for use in a method of treating a hyper-proliferative disease in a subject.

Particularly, the present invention covers an inhibitor of ATR kinase, particularly of Compound A, or a tautomer, an N-oxide, a hydrate, a solvate, or a pharmaceutically acceptable salt thereof, particularly Compound A, for use in a method of treating a hyper-proliferative disease in a subject, wherein said subject or the hyper-proliferative disease is characterized by one or more biomarker(s) defined herein.

Particularly, the present invention covers an inhibitor of ATR kinase, particularly of Compound A or a tautomer, an N-oxide, a hydrate, a solvate, or a pharmaceutically acceptable salt thereof, particularly Compound A, for use in the treatment of a hyper-proliferative disease in a subject, wherein said subject or the hyper-proliferative disease is characterized by one or more biomarker(s) defined herein.

In one embodiment of the invention said one or more biomarker(s) is (are) selected from
a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or b) the activation of the ALT pathway; and/or c) microsatellite instability, particularly high microsatellite instability.

In another embodiment of the invention said one or more biomarker(s) comprise(s) one or more deleterious mutation(s) in one or more gene(s)/protein(s) selected from BRCA1, ATM, BLM, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

In another embodiment of the invention said one or more biomarker(s) comprise(s) one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

The term "POLB/POLL" as used herein means a double mutation comprising one or more deleterious mutation(s) in POLB gene/protein and one or more deleterious mutation(s) in POLL gene/protein.

In another embodiment of the present invention said one or more biomarker(s) comprise(s) one or more deleterious mutation(s) in one or more gene(s)/protein(s) selected from BLM, BRCA1, ERCC5, FEN1, FANCD2, FANCG, H2AFX, PARP1, PCNA, POLL, POLB/POLL, RAD52, REV3L, TDP2, TP53BP1, UBE2N, XPA.

In a preferred embodiment of the present invention said one or more biomarker(s) comprise(s) one or more deleterious mutation(s) in one or more gene(s)/protein(s) selected from BLM, BRCA1, ERCC5, FEN1, FANCD2, H2AFX, PARP1, PCNA, RAD9A, RAD17, REV3L, TP53BP1, UBE2N.

In another embodiment of the present invention said one or more biomarker(s) comprise(s) one or more deleterious mutation(s) in one or more gene(s)/protein(s) selected from selected from BRCA1, ATM, FANCD2, H2AFX, RAD17, UBE2N.

In another preferred embodiment of the present invention said one or more biomarker(s) comprise(s) one or more deleterious mutation(s) in one or more gene(s)/protein(s) selected from selected from BRCA1, ATM, BLM, ERCC5, FEN1, FANCD2, H2AFX, PARP1, PCNA, REV3L, TP53BP1, UBE2N.

In another preferred embodiment of the present invention said one or more biomarker(s) comprise(s) one or more deleterious mutation(s) in one or more gene(s)/protein(s) selected from BLM, BRCA1, ERCC5, FEN1, FANCD2, H2AFX, PARP1, PCNA, REV3L, TP53BP1, UBE2N.

In another preferred embodiment of the present invention said one or more biomarker(s) comprise(s) one or more deleterious mutation(s) in one or more gene(s)/protein(s) selected from BRCA1, FEN1, H2AFX, PCNA.

In another embodiment of the present invention said one or more biomarker(s) comprise(s) one or more deleterious mutation(s) in TP53 gene/protein and one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

In another embodiment of the present invention said one or more biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, FANCG, H2AFX, PARP1, PCNA, POLL, POLB/POLL, RAD52, REV3L, TDP2, TP53BP1, UBE2N, XPA.

In another embodiment of the present invention said one or more biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, H2AFX, PARP1, PCNA, RAD9A, RAD17, REV3L, TP53BP1, UBE2N.

In another embodiment of the present invention said one or more biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, H2AFX, PARP1, PCNA, REV3L, TP53BP1, UBE2N.

In another embodiment of the present invention said one or more biomarker(s) comprise(s) one or more deleterious mutation(s) in TP53 gene/protein and one or more deleterious mutation(s) in one or more gene(s)/protein(s) selected from BRCA1, FEN1, H2AFX, PCNA.

Particularly, the present invention covers an inhibitor of ATR kinase, particularly of Compound A, or a tautomer, an N-oxide, a hydrate, a solvate, or a pharmaceutically acceptable salt thereof, particularly Compound A, for use in a method of treating a hyper-proliferative disease in a subject, wherein said subject or the hyper-proliferative disease is characterized by a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or b) the activation of the ALT pathway; and/or c) microsatellite instability, particularly high microsatellite instability.

In another embodiment of the present invention the subject or the hyper-proliferative disease is characterized by one or more biomarker(s) selected from one or more functional mutation(s) in one or more of the gene(s)/protein(s) defined herein.

In another embodiment of the present invention the subject or the hyper-proliferative disease is characterized by one or more biomarker(s) selected from the activation of the ALT pathway.

In another embodiment of the present invention the subject or the hyper-proliferative disease is characterized by one or more biomarker(s) selected from microsatellite instability, particularly high microsatellite instability (herein also referred to as "MSI-high").

In another embodiment of the present invention the subject or the hyper-proliferative disease is characterized by
a) one or more biomarker(s) selected from one or more functional mutation(s) in one or more gene(s)/protein(s) selected from APC, ARID1A, ATG5, ATM, ATR, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1C, DYRK1A, EGFR, ERBB2, ERBB3, ERCC2, ERCC3, ERCC5, FANCA, FANCB, FANCD2, FANCE, FANCI, FANCM, FBXO18, FBXW7, FEN1, GEN1, HDAC2, H2AFX, KRAS, LIG4, MDC1, MLH1, MLH3, MRE11A, MSH2, MSH3, MSH6, MYC, NBN, NRAS, PALB2, PARP4, PIK3CA, PMS2, POLA1, POLB, POLH, POLL, POLN, POLQ, PRKDC, PTEN, RAD17, RAD18, RAD50, RAD51, RAD54B, RAD54L, RB1, REV3L, SLX4, TDP1, TDP2, TMPRSS2, TMPRSS2-ERG, TOP2A, TOP2B, TOPBP1, TP53, TP53BP1, TRRAP, UBE2N, UIMC1, USP1, WDR48, WRN, XPA, XRCC1, XRCC2 and/or XRCC3 gene/protein; and/or
b) microsatellite instability, particularly high microsatellite instability.

In another embodiment of the present invention the subject or the hyper-proliferative disease is characterized by
a) one or more biomarker(s) selected from one or more functional mutation(s) in one or more gene(s)/protein(s) selected from APC, ARID1A, ATG5, ATM, ATR, ATRX, BARD1, BLM, BRAF, BRCA1, BRCA2, CCND1, CCNE1, CCNE2, CDC7, CHEK1, CHEK2, DCLRE1C, DYRK1A, EGFR, ERBB2, ERBB3, ERCC2, ERCC3, ERCC5, FANCA, FANCD2, FANCI, FANCM, HDAC2, KRAS, MLH1, MLH3, MRE11A, MSH2, MSH3, MSH6, MYC, NBN, NRAS, PALB2, PIK3CA, POLA1, POLN, POLQ, PRKDC, PTEN, RAD17, RAD18, RAD50, RAD51, RB1, REV3L, SLX4, TDP2, TMPRSS2, TMPRSS2-ERG, TOP2A, TOP2B, TOPBP1, TP53, TP53BP1, TRRAP, UBE2N, USP1, WDR48, WRN, XPA, XRCC1, XRCC2 and/or XRCC3 gene/protein; and/or
b) microsatellite instability, particularly high microsatellite instability.

In another embodiment of the present invention the subject or the hyper-proliferative disease is characterized by one or more biomarker(s) selected from one or more functional mutation(s) in one or more gene(s)/protein(s) selected from APC, ARID1A, ATG5, ATM, ATR, ATRIP, ATRX, BAP1, BARD1, BLM, BRCA1, BRCA2, BRIP1, CDK12, CHEK1, CHEK2, DCLRE1A, DCLRE1B, DCLRE1C, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, H2AFX, HDAC2, LIG4, MDC1, MLH1, MLH3, MRE11A, MSH2, MSH3, MSH6, NBN, PALB2, PARP1, PARP2, PARP3, PARP4, PMS2, POLA1, POLB, POLH, POLN, POLN, POLQ, PRKDC, PTEN, RAD17, RAD18, RAD50, RAD51, RAD52, RAD54B, RAD54L, RAD9A, RB1, REV3L, RPA1, RPA2, SLX4, TDP1, TDP2, TP53, TP53BP1, TRRAP, UBE2N, UIMC1, USP1, WDR48, WRN, XPA, XRCC1, XRCC2, XRCC3, XRCC4 and/or XRCC6 gene/protein, wherein the functional mutation is (are) a deleterious mutation(s).

In another embodiment of the present invention the subject or the hyper-proliferative disease is characterized by one or more biomarker(s) selected from one or more functional mutation(s) in one or more gene(s)/protein(s) selected from APC, ARID1A, ATG5, ATM, ATR, ATRX, BARD1, BLM, BRCA1, BRCA2, CHEK1, CHEK2, DCLRE1C, ERCC2, ERCC3, ERCC5, FANCA, FANCD2, FANCI, FANCM, HDAC2, MLH1, MLH3, MRE11A, MSH2, MSH3, MSH6, NBN, PALB2, POLA1, POLN, POLQ, PRKDC, PTEN, RAD17, RAD18, RAD50, RAD51, RB1, REV3L, SLX4, TDP2, TP53, TP53BP1, TRRAP, UBE2N, USP1, WDR48, WRN, XPA, XRCC1, XRCC2 and/or XRCC3 gene/protein, wherein the functional mutation is (are) a deleterious mutation(s).

In another embodiment of the present invention the subject or the hyper-proliferative disease is characterized by one or more biomarker(s) selected from one or more functional mutation(s) in one or more gene(s)/protein(s) selected from ATR, ATRIP, BRAF, CCND1, CCNE1, CCNE2, CDC7, DYRK1A, EGFR, ERBB2, ERBB3, HRAS, KRAS, MYC, NRAS, PCNA, PIK3CA, TMPRSS2, TOP2A, TOP2B, TOPBP1 and/or TP53 gene/protein, wherein the functional mutation is (are) an activating mutation(s).

In another embodiment of the present invention the subject or the hyper-proliferative disease is characterized by one or more biomarker(s) selected from one or more functional mutation(s) in one or more gene(s)/protein(s) selected from ATR, BRAF, CCND1, CCNE1, CCNE2, CDC7, DYRK1A, EGFR, ERBB2, ERBB3, KRAS, MYC, NRAS, PIK3CA, TMPRSS2, TOP2A, TOP2B, TOPBP1 and/or TP53 gene/protein, wherein the functional mutation is (are) an activating mutation(s).

In another embodiment of the present invention the subject or the hyper-proliferative disease is characterized by one or more biomarker(s), wherein the biomarker(s) comprise(s) one or more deleterious mutation(s) in one or more gene(s)/protein(s) selected from ATM, BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

In another embodiment of the present invention the subject or the hyper-proliferative disease is characterized by one or more biomarker(s), wherein the biomarker(s) comprise(s) one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

In another embodiment of the present invention the subject or the hyper-proliferative disease is characterized by one or more biomarker(s), wherein the biomarker(s) comprise(s) one or more deleterious mutation(s) in one or more gene(s)/protein(s) selected from BLM, BRCA1, ERCC5, FEN1, FANCD2, FANCG, H2AFX, PARP1, PCNA, POLL, POLB/POLL, RAD52, REV3L, TDP2, TP53BP1, UBE2N, XPA.

In a preferred embodiment of the present invention the subject or the hyper-proliferative disease is characterized by one or more biomarker(s), wherein the biomarker(s) comprise(s) one or more deleterious mutation(s) in one or more gene(s)/protein(s) selected from BLM, BRCA1, ERCC5,

FEN1, FANCD2, H2AFX, PARP1, PCNA, RAD9A, RAD17, REV3L, TP53BP1, UBE2N.

In a preferred embodiment of the present invention the subject or the hyper-proliferative disease is characterized by one or more biomarker(s), wherein the biomarker(s) comprise(s) one or more deleterious mutation(s) in one or more gene(s)/protein(s) selected from BLM, BRCA1, ERCC5, FEN1, FANCD2, H2AFX, PARP1, PCNA, REV3L, TP53BP1, UBE2N.

In another embodiment of the present invention the subject or the hyper-proliferative disease is characterized by one or more biomarker(s), wherein the biomarker(s) comprise(s) one or more deleterious mutation(s) in one or more gene(s)/protein(s) selected from BRCA1, ATM, FANCD2, H2AFX, RAD17, UBE2N.

In a preferred embodiment of the present invention the subject or the hyper-proliferative disease is characterized by one or more biomarker(s), wherein the biomarker(s) comprise(s) one or more deleterious mutation(s) in one or more gene(s)/protein(s) selected from BRCA1, FEN1, H2AFX, PCNA.

In another embodiment of the present invention the subject or the hyper-proliferative disease is characterized by one or more biomarker(s), wherein the biomarker(s) comprise(s) one or more deleterious mutation(s) in TP53 gene/protein and one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

In another embodiment of the present invention the subject or the hyper-proliferative disease is characterized by one or more biomarker(s), wherein the biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, FANCG, H2AFX, PARP1, PCNA, POLL, POLB/POLL, RAD52, REV3L, TDP2, TP53BP1, UBE2N, XPA.

In another embodiment of the present invention the subject or the hyper-proliferative disease is characterized by one or more biomarker(s), wherein the biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, H2AFX, PARP1, PCNA, RAD9A, RAD17, REV3L, TP53BP1, UBE2N.

In another embodiment of the present invention the subject or the hyper-proliferative disease is characterized by one or more biomarker(s), wherein the biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, H2AFX, PARP1, PCNA, REV3L, TP53BP1, UBE2N.

In another embodiment of the present invention the subject or the hyper-proliferative disease is characterized by one or more biomarker(s), wherein the biomarker(s) comprise(s) one or more deleterious mutation(s) in TP53 gene/protein and one or more deleterious mutation(s) in one or more gene(s)/protein(s) selected from BRCA1, FEN1, H2AFX, PCNA.

In another embodiment of the present invention the subject or the hyper-proliferative disease is characterized by one or more biomarker(s) selected from one or more functional mutation(s) of the gene(s)/protein(s), particularly deleterious and/or activating mutations, as described in Table 1 and/or in Table 2 infra:

TABLE 1

Deleterious mutations - examples

| Gene | Short insertions/deletions (INDELs) | Substitution-Nonsense | Substitution-Missense |
|---|---|---|---|
| APC | p.T1556fs*3/c.4666_4667insA | p.R24*/c.70C > T | p.A2D/c.5C > A |
| ATG5 | p.K235fs*4/c.704delA/ | p.R9*/c.25C > T | p.K58M/c.173A > T |
| ARID1A | p.S186fs*209/c.557_570del14 | p.Q605*/c.1813C > T | p.Q561H/c.1683G > C |
| ATM | p.E26fs*7/c.73_76delAAAG | p.R250*/c.748C > T | p.R2832C/c.8494C > T |
| ATR | p.I774fs*5/c.2320delA | p.E91*/c.271G > T | p.R1015Q/c.3044G > A |
| ATRIP | p.L63fs*8/c.186_189delGCTT | p.E338*/c.1012G > T | p.S310F/c.929C > T |
| ATRX | p.D275fs*13/c.824delA | p.G1304*/c.3910G > T | p.L192S/c.575T > C |
| BAP1 | p.K3fs*1/c.6_7insT | p.R60*/c.178C > T | p.G185R/c.553G > A |
| BARD1 | p.D172fs*40/c.513delA | p.S142*/c.425C > A | p.E268K/c.802G > A |
| BLM | p.N92fs*37/c.271delA | p.W934*/c.2801G > A | p.P30L/c.89C > T |
| BRCA1 | p.E23fs*17/c.66_67delAG | p.Q94*/c.2801G > A/ | p.M1V/c.1A > G |
| BRCA2 | p.K437fs*22/c.1301_1304delAAAG | p. E97*/c.289G > T | p.M1I/c.3G > A |
| BRIP1 | p.Y313fs*25/c.937delT | p.R261*/c.781A > T | p.D184Y/c.550G > T |
| CDK12 | p.L21fs*10/c.60_61delTT | p.K172*/c.514A > T | p.R890H/c.2669G > A |
| CHEK1 | p.L355fs*1/c.1061delT | p.R453*/c.1357A > T | p.G361D/c.1082G > A |
| CHEK2 | p.R132fs*29/c.394delA | p.L303*/c.908T > A | p.S428F/c.1283C > T |
| DCLRE1A | p.K346fs*7/c.1038delA | p.S45*/c.134C > A | p.P137S/c.409C > T |
| DCLRE1B | C149fs*28/c.443_444insT | p.W44*/c.132G > A | p.D96N/c.286G > A |
| DCLRE1C | p.Y99fs*7/c.295_296insT | p.G70*/c.208G > T | p.Q137H/c.411G > C |
| ERCC2 | p.E294fs*40/c.880delG | p.S74*/c.221C > G | p.V231M/c.691G > A |
| ERCC3 | p.W493fs*7/c.1475_1476insT | p.R452*/c.1354C > T | p.D60N/c.178G > A |
| ERCC4 | p.K916fs?/c.2743delA | p.Q5*/c.13C > T | p.T809M/c.2426C > T |
| ERCC5 | p.E164fs*6/c.485delA | p.C12*/c.36C > A | p.M222I/c.666G > A |
| FAM175A | p.E204fs*1/c.609_610insT | p.E142*/c.424G > T | p.Y219C/c.656A > G |
| FANCA | p.L72fs*6/c.215delT | p.Q1389*/c.4165C > T | p.M415I/c.1245G > A |
| FANCB | p.F25fs*43/c.74delT | p.Q512*/c.1534C > T | p.L27F/c.81G > T |
| FANCC | p.N152fs*6/c.455delA | p.R174*/c.520C > T | p.R245W/c.733C > T |
| FANCD2 | p.L446fs*17/c.1332_1333delCT | p.R408*/c.1222C > T | p.R1299H/c.3896G > A |
| FANCE | p.L173fs*15/c.515_516insC | p.E235*/c.703G > T | p.Q285H/c.855G > T |
| FANCF | p.D27fs*54/c.79delG | p.S18*/c.53C > G | p.R10C/c.28C > T |
| FANCG | p.S387fs*16/c.1158delC | p.R102*/c.304A > T | p.L589P/c.1766T > C |

TABLE 1-continued

Deleterious mutations - examples

| Gene | Short insertions/deletions (INDELs) | Substitution-Nonsense | Substitution-Missense |
|---|---|---|---|
| FANCI | p.H1218fs*2/c.3654delC | p.Q208*/c.622C > T | p.G119V/c.356G > T |
| FANCL | p.S351fs*2/c.1051__1052delAG | p.W57*/c.170G > A | p.M74I/c.222G > A |
| FANCM | p.L57fs*9/c.166__167insT | p.S1618*/c.4853C > G | p.S1665F/c.4994C > T |
| FBXO18 | p.L116fs*1/c.345delC | p.Q643*/c.1927C > T | p.R754Q/c.2261G > A |
| FBXW7 | p.T165fs*4/c.493delA | p.S294*/c.881C > G | p.R465C/c.1393C > T |
| FEN1 |  | p.Q54*/c.160C > T | p.P89L/c.266C > T |
| GEN1 | p.M44fs*1/c.124delA | p.C117*/c.351C > A | p.R93W/c.277C > T |
| H2AFX | p.P49fs*13/c.146__147delCA |  | p.E42K/c.124G > A |
| HDAC2 | p.T459fs* > 30/c.1375delA | p.E185*/c.553C > T | p.V154A/c.461T > C |
| LIG4 | p.K424fs*20/c.1271__1275delAAAGA | p.R37*/c.109A > T | p.D165G/c.494A > G |
| MDC1 | p.D580fs*36/c.1738__1739delGA | p.E14*/c.40G > T | p.E149A/c.446A > C |
| MLH1 | p.K196fs*6/c.583delA | p.R226*/c.676C > T | p.E172K/c.514G > A |
| MLH3 | p.N434fs*4/c.1295__1296insA | p.Q173*/c.517C > T | p.M181I/c.543G > A |
| MRE11A | p.G114fs*31/c.341delG | p.Q97*/c.289C > T | p.D86N/c.256G > A |
| MSH2 | p.F85fs*1/c.252__253delTT | p.Q215*/c.643C > T | p.G221V/c.662G > T |
| MSH3 | p.D190fs*1/c.562__563insT | p.Y227*/c.681C > G | p.N365H/c.1093A > C |
| MSH6 | p.L290fs*1/c.867delC | p.Q4*/c.10C > T | p.V474A/c.1421T > C |
| NBN | p.R466fs*18/c.1396delA | p.R43*/c.127C > T | p.I35T/c.104T > C |
| PALB2 | p.N186fs*4/c.552__553insA | p.Q552*/c.1654C > T | p.Q479H/c.1437G > C |
| PARP1 | p.P359fs*22/c.1076delC | p.E297*/c.889G > T | p.K59N/c.177G > T |
| PARP2 | p.R13fs*10/c.36__37ins14 | p.R395*/c.1183C > T | p.R241W/c.721C > T |
| PARP3 | p.A300fs*29/c.894__897delGCAG | pQ340*/c.1018C > T | p.R524H/c.1571G > A |
| PARP4 | p.K629fs*19/c.1885__1888AAAG > GA | p.E83*/c.247G > T | p.G1003S/c.3007G > A |
| PMS2 | p.E109fs*3/c.325delG | p.K647*/c.1939A > T | p.H24Y/c.70C > T |
| POLA1 | p.Q32fs*4/c.93delC | p.E276*/c.826G > T | p.E89V/c.266A > T |
| POLB | p.N128fs*5/c.378delA | p.Q159*/c.475C > T | p.P251S/c.751C > T |
| POLH | p.F18fs*12/c.48delT | p.Q543*/c.1627C > T | p.M14V/c.40A > G |
| POLL | p.C198fs*2/c.587__588insT | p.R549*/c.1645C > T | p.A285T/c.853G > A |
| POLN | p.F332fs*14/c.996delT | p.E599*/c.1795G > T | p.G419D/c.1256G > A |
| POLQ | p.K1068fs*2/c.3204delA | p.R602*/c.1804C > T | p.R375W/c.1123C > T |
| PRKDC | p.L65fs*13/c.194__195insT | p.E84*/c.250G > T | p.Q16K/c.46C > A |
| PTEN | p.K6fs*4/c.16__17delAA | p.L25*/c.74T > A | p.I101T/c.302T > C |
| RAD17 | p.N51fs*6/c.147delA | p.K107*/c.319A > T | p.K370N/c.1110A > C |
| RAD18 | p.K345fs*28/c.1035delA | p.E152*/c.454G > T | p.K52T/c.155A > C |
| RAD50 | p.N320fs*5/c.954__955insA | p.W25*/c.75G > A | p.E387D/c.1161G > T |
| RAD51 | p.Y54fs*11/c.159__160insG | p.Q30*/c.88C > T | p.E258D/c.774G > T |
| RAD52 | p.V105fs*7/c.313delG | p.Q221*/c.661C > T | p.R46K/c.137G > A |
| RAD54B | p.P18fs*10/c.51__52insA | p.E75*/c.223G > T | p.L528F/c.1582C > T |
| RAD54L | p.L113fs*10/c.336__337insT | p.R75*/c.223C > T | p.F163L/c.489C > A |
| RAD9A | p.K96fs*6/c.284delA | p.Q205*/c.613C > T | p.R150W/c.448C > T |
| RB1 | p.I124fs*6/c.370__371delAT | p.E54*/c.160G > T | p.V654M/c.1960G > A |
| REV3L | p.N639fs*16/c.1916delA | p.E1707*/c.5119G > T | p.K1512N/c.4536A > C |
| RPA1 | p.F222fs*3/c.662delT | p.R586*/c.1756C > T | p.V27F/c.79G > T |
| RPA2 | p.V207fs*26/c.620__621delTG | p.Y97*/c.291T > A | p.G204D/c.611G > A |
| SLX4 | p.L470fs*8/c.1406__1407insC | p.E53*/c.157G > T | p.K301N/c.903G > T |
| TDP1 | p.P359fs*21/c.1073delC | p.K177*/c.529A > T | p.K292E/c.874A > G |
| TDP2 | p.K24fs*35/c.71delA | p.W52*/c.156G > A | p.E176D/c.528A > C |
| TP53 | p.L35fs*8/c.102__103insT | p.R213*/c.637C > T | p.R175G/c.523C > G (Ref 1) |
| TP53BP1 | p.N419fs*67/c.1256delA | p.Q106*/c.316C > T | p.F307L/c.919T > C |
| TRRAP | p.F468fs*52/c.1400delT | p.R1650*/c.4948C > T | p.S722F/c.2165C > T |
| UBE2N | p.I75fs*6/c.223delA | p.Q100*/c.298C > T | p.R7S/c.21G > T |
| UIMC1 | p.T189fs*2/c.565__566insA | p.W183*/c.549G > A | p.S44F/c.131C > T |
| USP1 | p.N21fs*14/c.57__58insA | p.R180*/c.538C > T | p.E250G/c.749A > G |
| WDR48 | p.W195fs*13/c.580__581insT | p.G107*/c.319G > T | p.R235C/c.703C > T |
| WRN | p.M497fs*60/c.1485delA | p.E48*/c.142G > T | p.W85L/c.254G > T |
| XPA | p.C153fs*1/c.459__460delTG | p.E84*/c.250G > T | p.E106K/c.316G > A |
| XRCC1 | p.G61fs*3/c.180__181insT | p.Q134*/c.400C > T | p.R350W/c.1048C > T |
| XRCC2 | p.K267fs* > 14/c.801delA |  | p.R91Q/c.272G > A |
| XRCC3 | p.T77fs*28/c.228__229insC |  | p.S23L/c.68C > T |
| XRCC4 | p.C128fs*25/c.380delT | p.E295*/c.883C > T | p.P14A/c.40C > G |
| XRCC6 | p.L41fs*17/c.116delT | p.R80*/c.238C > T | p.G28E/c.83G > A |

Ref 1: Xu Y, Induction of genetic instability by gain-of-function p53 cancer mutants. Oncogene. 2008 27(25): 3501-7.

TABLE 2

Activating mutations - examples

| Gene | Missense alteration | Fusion |
|---|---|---|
| BRAF | p.V600E/c.1799T > A | AKAP9{ENST00000356239}: r.1__3551_BRAF{ENST00000288602}:r.1202__2480 |
| EGFR | .L858R/c.2573T > G |  |

TABLE 2-continued

Activating mutations - examples

| Gene | Missense alteration | Fusion |
| --- | --- | --- |
| ERBB2 | p.S1050L/c.3149C > T | |
| ERBB3 | p.Q1239H/c.3717G > C | |
| PIK3CA | p.H1047R/c.3140A > G | |
| TMPRSS2 | | TMPRSS2{ENST00000332149}: r.1_79_ERG{ENST00000442448}:r.312_5034 |
| DYRK1A | p.R559C/c.1675C > T | |
| PCNA | p.I88V/c.262A > G | |
| NRAS | p.Q61L/c.182A > T | |
| MYC | p.P57S/c.169C > T | |
| KRAS | p.G12D/c.35G > A | |
| HRAS | p.Q61L/c.182A > T | |
| CDC7 | p.E25K/c.73G > A | |
| CCNE2 | p.W327R/c.979T > C | |
| CCNE1 | p.R240C/c.718C > T | |
| CCND1 | p.D240H/c.718G > C | |
| TOP2A | p.R268H/c.803G > A | |
| TOP2B | p.H977Y/c.2929C > T | |
| TOPBP1 | P.F699C/c.2096T > G | |
| TP53 | p.R273H/c.818G > A (Ref 1) | |

Further examples of deleterious/activating mutations of the gene(s) mentioned herein are described in publically available databases, such as e.g. ClinVar (Landrum M J, Lee J M, Riley G R, et al., "ClinVar: public archive of relationships among sequence variation and human phenotype", Nucleic Acids Res. 2014; 42:D980-5; https://www.ncbi.nlm.nih.gov/clinvar), HGMD (the Human Gene Mutation Database, http://www.hgmd.cf.ac.uk/ac/index.php; Stenson P D, Mort M, Ball E V, et al., "The human gene mutation database: 2008 update.", Genome Med. 2009; 1:13) or in "The Human Variome Project" (http://www.humanvariomeproject.org; Timothy D Smith and Mauno Vihinen, "Standard development at the Human Variome Project", Database 2015, 2015), which has curated a gene-/disease-specific databases to collect the sequence variants and genes associated with diseases.

Further examples of deleterious/activating mutations of the gene(s), which may be used in context with the method(s)/use(s)/kit(s)/pharmaceutical composition(s) of the present invention, are described in COSMIC database (www.cancer.sanger.ac.uk; "COSMIC: exploring the world's knowledge of somatic mutations in human cancer", Forbes et al., Nucleic Acids Res. 2015, January; 43 (Database issue):D805-11. doi: 10.1093/nar/gku1075. Epub 2014 Oct. 29), particularly in release 79 of COSMIC (COSMIC v79), which was released on 14 Nov. 2016.

Examples of relevant functional mutations of the TMPRSS2-ERG fusion gene/protein are described for example in Tomlins et al. (Science (New York, N.Y.) 2005; 310(5748):644-648); Soller et al. (Genes, chromosomes & cancer 2006; 45(7):717-719); Clark et al. (Oncogene 2007; 26(18):2667-2673); Wang et al. (Cancer research 2006; 66(17):8347-8351); or in Tu et al. (Modern pathology: an official journal of the United States and Canadian Academy of Pathology, Inc 2007, 20(9):921-928). In another embodiment of the present invention the subject or the hyper-proliferative disease is characterized by one or more biomarker(s) selected from one or more functional mutation(s) of the gene(s)/protein(s) which are described in the Experimental Section infra.

In another embodiment the subject or the hyper-proliferative disease is characterized by one or more biomarker(s), wherein the biomarker(s) comprise(s) one or more functional mutation(s), particularly deleterious mutation(s), of the APC gene/protein.

In another embodiment the subject or the hyper-proliferative disease is characterized by one or more biomarker(s), wherein the biomarker comprise(s) one or more functional mutation(s), particularly deleterious mutation(s), of the ATG5 gene.

In another embodiment the subject or the hyper-proliferative disease is characterized by one or more biomarker(s), wherein the biomarker comprise(s) one or more functional mutation(s), particularly deleterious mutation(s), of the ARID1A gene.

In another embodiment the subject or the hyper-proliferative disease is characterized by one or more biomarker(s), wherein the biomarker comprise(s) one or more functional mutation(s), particularly deleterious mutation(s), of the ATM gene/protein.

In another embodiment the subject or the hyper-proliferative disease is characterized by one or more biomarker(s), wherein the biomarker invention comprise(s) one or more functional mutation(s), particularly deleterious or activating mutation(s), of the ATR gene/protein.

In another embodiment the subject or the hyper-proliferative disease is characterized by one or more biomarker(s), wherein the biomarker comprise(s) one or more functional mutation(s), particularly deleterious or activating mutation(s), of the ATRIP gene/protein.

In another embodiment the subject or the hyper-proliferative disease is characterized by one or more biomarker(s), wherein the biomarker comprise(s) one or more functional mutation(s), particularly deleterious mutation(s), of the ATRX gene/protein.

In another embodiment the subject or the hyper-proliferative disease is characterized by one or more biomarker(s), wherein the biomarker comprise(s) one or more functional mutation(s), particularly deleterious mutation(s), of the BAP1 gene/protein.

In another embodiment the subject or the hyper-proliferative disease is characterized by one or more biomarker(s), wherein the biomarker comprise(s) one or more functional mutation(s), particularly deleterious mutation(s), of the BARD1 gene/protein.

In another embodiment the subject or the hyper-proliferative disease is characterized by one or more biomarker(s), wherein the biomarker comprise(s) one or more functional mutation(s), particularly deleterious mutation(s), of the BLM gene/protein.

In another embodiment the subject or the hyper-proliferative disease is characterized by one or more biomarker(s), wherein the biomarker comprise(s) one or more functional mutation(s), particularly activating mutation(s), of the BRAF gene/protein.

In another embodiment the subject or the hyper-proliferative disease is characterized by one or more biomarker(s), wherein the biomarker comprise(s) one or more functional mutation(s), particularly deleterious mutation(s), of the BRCA1 gene/protein.

In another embodiment the subject or the hyper-proliferative disease is characterized by one or more biomarker(s), wherein the biomarker comprise(s) one or more functional mutation(s), particularly deleterious mutation(s), of the BRCA2 gene/protein.

In another embodiment the subject or the hyper-proliferative disease is characterized by one or more biomarker(s), wherein the biomarker comprise(s) one or more functional mutation(s), particularly deleterious mutation(s), of the BRIP1 gene/protein.

In another embodiment the subject or the hyper-proliferative disease is characterized by one or more biomarker(s), wherein the biomarker comprise(s) one or more functional mutation(s), particularly activating mutation(s), of the CCND1 gene/protein.

In another embodiment the subject or the hyper-proliferative disease is characterized by one or more biomarker(s), wherein the biomarker comprise(s) one or more functional mutation(s), particularly activating mutation(s), of the CCNE1 gene/protein.

In another embodiment the subject or the hyper-proliferative disease is characterized by one or more biomarker(s), wherein the biomarker comprise(s) one or more functional mutation(s), particularly activating mutation(s), of the CCNE2 gene/protein.

In another embodiment the subject or the hyper-proliferative disease is characterized by one or more biomarker(s), wherein the biomarker comprise(s) one or more functional mutation(s), particularly activating mutation(s), of the $CDCl_7$ gene/protein.

In another embodiment the subject or the hyper-proliferative disease is characterized by one or more biomarker(s), wherein the biomarker comprise(s) one or more functional mutation(s), particularly deleterious mutation(s), of the CDK12 gene/protein.

In another embodiment the subject or the hyper-proliferative disease is characterized by one or more biomarker(s), wherein the biomarker comprise(s) one or more functional mutation(s), particularly deleterious mutation(s), of the CHEK1 gene/protein.

In another embodiment the subject or the hyper-proliferative disease is characterized by one or more biomarker(s), wherein the biomarker comprise(s) one or more functional mutation(s), particularly deleterious mutation(s), of the CHEK2 gene/protein.

In another embodiment the subject or the hyper-proliferative disease is characterized by one or more biomarker(s), wherein the biomarker comprise(s) one or more functional mutation(s), particularly deleterious mutation(s), of the DCLRE1A gene/protein.

In another embodiment the subject or the hyper-proliferative disease is characterized by one or more biomarker(s), wherein the biomarker comprise(s) one or more functional mutation(s), particularly deleterious mutation(s), of the DCLRE1B gene/protein.

In another embodiment the subject or the hyper-proliferative disease is characterized by one or more biomarker(s), wherein the biomarker comprise(s) one or more functional mutation(s), particularly deleterious mutation(s), of the DCLRE1C gene/protein.

In another embodiment the subject or the hyper-proliferative disease is characterized by one or more biomarker(s), wherein the biomarker comprise(s) one or more functional mutation(s), particularly activating mutation(s), of the DYRK1A gene/protein.

In another embodiment the subject or the hyper-proliferative disease is characterized by one or more biomarker(s), wherein the biomarker comprise(s) one or more functional mutation(s), particularly activating mutation(s), of the EGFR gene/protein.

In another embodiment the subject or the hyper-proliferative disease is characterized by one or more biomarker(s), wherein the biomarker comprise(s) one or more functional mutation(s), particularly activating mutation(s), of the ERBB2 gene/protein.

In another embodiment the subject or the hyper-proliferative disease is characterized by one or more biomarker(s), wherein the biomarker comprise(s) one or more functional mutation(s), particularly activating mutation(s), of the ERBB3 gene/protein.

In another embodiment the subject or the hyper-proliferative disease is characterized by one or more biomarker(s), wherein the biomarker comprise(s) one or more functional mutation(s), particularly deleterious mutation(s), of the ERCC2 gene/protein.

In another embodiment the subject or the hyper-proliferative disease is characterized by one or more biomarker(s), wherein the biomarker comprise(s) one or more functional mutation(s), particularly deleterious mutation(s), of the ERCC3 gene/protein.

In another embodiment the subject or the hyper-proliferative disease is characterized by one or more biomarker(s), wherein the biomarker comprise(s) one or more functional mutation(s), particularly deleterious mutation(s), of the ERCC4 gene/protein.

In another embodiment the subject or the hyper-proliferative disease is characterized by one or more biomarker(s), wherein the biomarker comprise(s) one or more functional mutation(s), particularly deleterious mutation(s), of the ERCC5 gene/protein.

In another embodiment the subject or the hyper-proliferative disease is characterized by one or more biomarker(s), wherein the biomarker comprise(s) one or more functional mutation(s), particularly deleterious mutation(s), of the FAM175A gene/protein.

In another embodiment the subject or the hyper-proliferative disease is characterized by one or more biomarker(s), wherein the biomarker comprise(s) one or more functional mutation(s), particularly deleterious mutation(s), of the FANCA gene/protein.

In another embodiment the subject or the hyper-proliferative disease is characterized by one or more biomarker(s), wherein the biomarker comprise(s) one or more functional mutation(s), particularly deleterious mutation(s), of the FANCB gene/protein.

In another embodiment the subject or the hyper-proliferative disease is characterized by one or more biomarker(s), wherein the biomarker comprise(s) one or more functional mutation(s), particularly deleterious mutation(s), of the FANCC gene/protein.

In another embodiment the subject or the hyper-proliferative disease is characterized by one or more biomarker(s), wherein the biomarker comprise(s) one or more functional mutation(s), particularly deleterious mutation(s), of the FANCD2 gene/protein.

In another embodiment the subject or the hyper-proliferative disease is characterized by one or more biomarker(s), wherein the biomarker comprise(s) one or more functional mutation(s), particularly deleterious mutation(s), of the FANCE gene/protein.

In another embodiment the subject or the hyper-proliferative disease is characterized by one or more biomarker(s), wherein the biomarker comprise(s) one or more functional mutation(s), particularly deleterious mutation(s), of the FANCF gene/protein.

In another embodiment the subject or the hyper-proliferative disease is characterized by one or more biomarker(s), wherein the biomarker comprise(s) one or more functional mutation(s), particularly deleterious mutation(s), of the FANCG gene/protein.

In another embodiment the subject or the hyper-proliferative disease is characterized by one or more biomarker(s), wherein the biomarker comprise(s) one or more functional mutation(s), particularly deleterious mutation(s), of the FANCI gene/protein.

In another embodiment the subject or the hyper-proliferative disease is characterized by one or more biomarker(s), wherein the biomarker comprise(s) one or more functional mutation(s), particularly deleterious mutation(s), of the FANCL gene/protein.

In another embodiment the subject or the hyper-proliferative disease is characterized by one or more biomarker(s), wherein the biomarker comprise(s) one or more functional mutation(s), particularly deleterious mutation(s), of the FANCM gene/protein.

In another embodiment the subject or the hyper-proliferative disease is characterized by one or more biomarker(s), wherein the biomarker comprise(s) one or more functional mutation(s), particularly deleterious mutation(s), of the FBXO18 gene/protein.

In another embodiment the subject or the hyper-proliferative disease is characterized by one or more biomarker(s), wherein the biomarker comprise(s) one or more functional mutation(s), particularly deleterious mutation(s), of the FBXW7 gene/protein.

In another embodiment the subject or the hyper-proliferative disease is characterized by one or more biomarker(s), wherein the biomarker comprise(s) one or more functional mutation(s), particularly deleterious mutation(s), of the FEN1 gene/protein.

In another embodiment the subject or the hyper-proliferative disease is characterized by one or more biomarker(s), wherein the biomarker comprise(s) one or more functional mutation(s), particularly deleterious mutation(s), of the GEN1 gene/protein.

In another embodiment the subject or the hyper-proliferative disease is characterized by one or more biomarker(s), wherein the biomarker comprise(s) one or more functional mutation(s), particularly deleterious mutation(s), of the HDAC2 gene/protein.

In another embodiment the subject or the hyper-proliferative disease is characterized by one or more biomarker(s), wherein the biomarker comprise(s) one or more functional mutation(s), particularly deleterious mutation(s), of the H2AFX gene/protein.

In another embodiment the subject or the hyper-proliferative disease is characterized by one or more biomarker(s), wherein the biomarker comprise(s) one or more functional mutation(s), particularly activating mutation(s), of the HRAS gene/protein.

In another embodiment the subject or the hyper-proliferative disease is characterized by one or more biomarker(s), wherein the biomarker comprise(s) one or more functional mutation(s), particularly activating mutation(s), of the KRAS gene/protein.

In another embodiment the subject or the hyper-proliferative disease is characterized by one or more biomarker(s), wherein the biomarker comprise(s) one or more functional mutation(s), particularly deleterious mutation(s), of the LIG4 gene/protein.

In another embodiment the subject or the hyper-proliferative disease is characterized by one or more biomarker(s), wherein the biomarker comprise(s) one or more functional mutation(s), particularly deleterious mutation(s), of the MDC1 gene/protein.

In another embodiment the subject or the hyper-proliferative disease is characterized by one or more biomarker(s), wherein the biomarker comprise(s) one or more functional mutation(s), particularly deleterious mutation(s), of the MLH1 gene/protein.

In another embodiment the subject or the hyper-proliferative disease is characterized by one or more biomarker(s), wherein the biomarker comprise(s) one or more functional mutation(s), particularly deleterious mutation(s), of the MLH3 gene/protein.

In another embodiment the subject or the hyper-proliferative disease is characterized by one or more biomarker(s), wherein the biomarker comprise(s) one or more functional mutation(s), particularly deleterious mutation(s), of the MRE11A gene/protein.

In another embodiment the subject or the hyper-proliferative disease is characterized by one or more biomarker(s), wherein the biomarker comprise(s) one or more functional mutation(s), particularly deleterious mutation(s), of the MSH2 gene/protein.

In another embodiment the subject or the hyper-proliferative disease is characterized by one or more biomarker(s), wherein the biomarker comprise(s) one or more functional mutation(s), particularly deleterious mutation(s), of the MSH3 gene/protein.

In another embodiment the subject or the hyper-proliferative disease is characterized by one or more biomarker(s), wherein the biomarker comprise(s) one or more functional mutation(s), particularly deleterious mutation(s), of the MSH6 gene/protein.

In another embodiment the subject or the hyper-proliferative disease is characterized by one or more biomarker(s), wherein the biomarker comprise(s) one or more functional mutation(s), particularly activating mutation(s), of the MYC gene/protein.

In another embodiment the subject or the hyper-proliferative disease is characterized by one or more biomarker(s), wherein the biomarker comprise(s) one or more functional mutation(s), particularly deleterious mutation(s), of the NBN gene/protein.

In another embodiment the subject or the hyper-proliferative disease is characterized by one or more biomarker(s), wherein the biomarker comprise(s) one or more functional mutation(s), particularly activating mutation(s), of the NRAS gene/protein.

In another embodiment the subject or the hyper-proliferative disease is characterized by one or more biomarker(s), wherein the biomarker comprise(s) one or more functional mutation(s), particularly deleterious mutation(s), of the PALB2 gene/protein.

In another embodiment the subject or the hyper-proliferative disease is characterized by one or more biomarker(s), wherein the biomarker comprise(s) one or more functional mutation(s), particularly deleterious mutation(s), of the PARP1 gene/protein.

In another embodiment the subject or the hyper-proliferative disease is characterized by one or more biomarker(s), wherein the biomarker comprise(s) one or more functional mutation(s), particularly deleterious mutation(s), of the PARP2 gene/protein.

In another embodiment the subject or the hyper-proliferative disease is characterized by one or more biomarker(s), wherein the biomarker comprise(s) one or more functional mutation(s), particularly deleterious mutation(s), of the PARP3 gene/protein.

In another embodiment the subject or the hyper-proliferative disease is characterized by one or more biomarker(s), wherein the biomarker comprise(s) one or more functional mutation(s), particularly deleterious mutation(s), of the PARP4 gene/protein.

In another embodiment the subject or the hyper-proliferative disease is characterized by one or more biomarker(s), wherein the biomarker comprise(s) one or more functional mutation(s), particularly deleterious mutation(s), of the PCNA gene/protein.

In another embodiment the subject or the hyper-proliferative disease is characterized by one or more biomarker(s), wherein the biomarker comprise(s) one or more functional mutation(s), particularly activating mutation(s), of the PIK3CA gene/protein.

In another embodiment the subject or the hyper-proliferative disease is characterized by one or more biomarker(s), wherein the biomarker comprise(s) one or more functional mutation(s), particularly deleterious mutation(s), of the PMS2 gene/protein.

In another embodiment the subject or the hyper-proliferative disease is characterized by one or more biomarker(s), wherein the biomarker comprise(s) one or more functional mutation(s), particularly deleterious mutation(s), of the POLA1 gene/protein.

In another embodiment the subject or the hyper-proliferative disease is characterized by one or more biomarker(s), wherein the biomarker comprise(s) one or more functional mutation(s), particularly deleterious mutation(s), of the POLB gene/protein.

In another embodiment the subject or the hyper-proliferative disease is characterized by one or more biomarker(s), wherein the biomarker comprise(s) one or more functional mutation(s), particularly deleterious mutation(s), of the POLH gene/protein.

In another embodiment the subject or the hyper-proliferative disease is characterized by one or more biomarker(s), wherein the biomarker comprise(s) one or more functional mutation(s), particularly deleterious mutation(s), of the POLL gene/protein.

In another embodiment the subject or the hyper-proliferative disease is characterized by one or more biomarker(s), wherein the biomarker comprise(s) one or more functional mutation(s), particularly deleterious mutation(s), of the POLN gene/protein.

In another embodiment the subject or the hyper-proliferative disease is characterized by one or more biomarker(s), wherein the biomarker comprise(s) one or more functional mutation(s), particularly deleterious mutation(s), of the POLQ gene/protein.

In another embodiment the subject or the hyper-proliferative disease is characterized by one or more biomarker(s), wherein the biomarker comprise(s) one or more functional mutation(s), particularly deleterious mutation(s), of the PRKDC gene/protein.

In another embodiment the subject or the hyper-proliferative disease is characterized by one or more biomarker(s), wherein the biomarker comprise(s) one or more functional mutation(s), particularly deleterious mutation(s), of the PTEN gene/protein.

In another embodiment the subject or the hyper-proliferative disease is characterized by one or more biomarker(s), wherein the biomarker comprise(s) one or more functional mutation(s), particularly deleterious mutation(s), of the RAD9A gene/protein.

In another embodiment the subject or the hyper-proliferative disease is characterized by one or more biomarker(s), wherein the biomarker comprise(s) one or more functional mutation(s), particularly deleterious mutation(s), of the RAD17 gene/protein.

In another embodiment the subject or the hyper-proliferative disease is characterized by one or more biomarker(s), wherein the biomarker comprise(s) one or more functional mutation(s), particularly deleterious mutation(s), of the RAD18 gene/protein.

In another embodiment the subject or the hyper-proliferative disease is characterized by one or more biomarker(s), wherein the biomarker comprise(s) one or more functional mutation(s), particularly deleterious mutation(s), of the RAD50 gene/protein.

In another embodiment the subject or the hyper-proliferative disease is characterized by one or more biomarker(s), wherein the biomarker comprise(s) one or more functional mutation(s), particularly deleterious mutation(s), of the RAD51 gene/protein.

In another embodiment the subject or the hyper-proliferative disease is characterized by one or more biomarker(s), wherein the biomarker comprise(s) one or more functional mutation(s), particularly deleterious mutation(s), of the RAD52 gene/protein.

In another embodiment the subject or the hyper-proliferative disease is characterized by one or more biomarker(s), wherein the biomarker comprise(s) one or more functional mutation(s), particularly deleterious mutation(s), of the RAD54B gene/protein.

In another embodiment the subject or the hyper-proliferative disease is characterized by one or more biomarker(s), wherein the biomarker comprise(s) one or more functional mutation(s), particularly deleterious mutation(s), of the RAD54L gene/protein.

In another embodiment the subject or the hyper-proliferative disease is characterized by one or more biomarker(s), wherein the biomarker comprise(s) one or more functional mutation(s), particularly deleterious mutation(s), of the RB1 gene/protein.

In another embodiment the subject or the hyper-proliferative disease is characterized by one or more biomarker(s), wherein the biomarker comprise(s) one or more functional mutation(s), particularly deleterious mutation(s), of the REV3L gene/protein.

In another embodiment the subject or the hyper-proliferative disease is characterized by one or more biomarker(s), wherein the biomarker comprise(s) one or more functional mutation(s), particularly deleterious mutation(s), of the RPA1 gene/protein.

In another embodiment the subject or the hyper-proliferative disease is characterized by one or more biomarker(s), wherein the biomarker comprise(s) one or more functional mutation(s), particularly deleterious mutation(s), of the RPA2 gene/protein.

In another embodiment the subject or the hyper-proliferative disease is characterized by one or more biomarker(s), wherein the biomarker comprise(s) one or more functional mutation(s), particularly deleterious mutation(s), of the SLX4 gene/protein.

In another embodiment the subject or the hyper-proliferative disease is characterized by one or more biomarker(s), wherein the biomarker comprise(s) one or more functional mutation(s), particularly deleterious mutation(s), of the TDP1 gene/protein.

In another embodiment the subject or the hyper-proliferative disease is characterized by one or more biomarker(s), wherein the biomarker comprise(s) one or more functional mutation(s), particularly deleterious mutation(s), of the TDP2 gene/protein.

In another embodiment the subject or the hyper-proliferative disease is characterized by one or more biomarker(s), wherein the biomarker comprise(s) one or more functional mutation(s), particularly activating mutation(s), of the TMPRSS2 gene/protein.

In another embodiment the subject or the hyper-proliferative disease is characterized by one or more biomarker(s), wherein the biomarker comprise(s) one or more functional mutation(s), particularly deleterious or activating mutation(s), of the TMPRSS2-ERG gene/protein.

In another embodiment the subject or the hyper-proliferative disease is characterized by one or more biomarker(s), wherein the biomarker comprise(s) one or more functional mutation(s), particularly activating mutation(s), of the TOPBP1 gene/protein.

In another embodiment the subject or the hyper-proliferative disease is characterized by one or more biomarker(s), wherein the biomarker comprise(s) one or more functional mutation(s), particularly activating mutation(s), of the TOP2A gene/protein.

In another embodiment the subject or the hyper-proliferative disease is characterized by one or more biomarker(s), wherein the biomarker comprise(s) one or more functional mutation(s), particularly activating mutation(s), of the TOP2B gene/protein.

In another embodiment the subject or the hyper-proliferative disease is characterized by one or more biomarker(s), wherein the biomarker comprise(s) one or more functional mutation(s), particularly deleterious or activating mutation(s), of the TP53 gene/protein.

In another embodiment the subject or the hyper-proliferative disease is characterized by one or more biomarker(s), wherein the biomarker comprise(s) one or more functional mutation(s), particularly deleterious mutation(s), of the TP53BP1 gene/protein.

In another embodiment the subject or the hyper-proliferative disease is characterized by one or more biomarker(s), wherein the biomarker comprise(s) one or more functional mutation(s), particularly deleterious mutation(s), of the TRRAP gene/protein.

In another embodiment the subject or the hyper-proliferative disease is characterized by one or more biomarker(s), wherein the biomarker comprise(s) one or more functional mutation(s), particularly deleterious mutation(s), of the UBE2N gene/protein.

In another embodiment the subject or the hyper-proliferative disease is characterized by one or more biomarker(s), wherein the biomarker comprise(s) one or more functional mutation(s), particularly deleterious mutation(s), of the UIMC1 gene/protein.

In another embodiment the subject or the hyper-proliferative disease is characterized by one or more biomarker(s), wherein the biomarker comprise(s) one or more functional mutation(s), particularly deleterious mutation(s), of the USP1 gene/protein.

In another embodiment the subject or the hyper-proliferative disease is characterized by one or more biomarker(s), wherein the biomarker comprise(s) one or more functional mutation(s), particularly deleterious mutation(s), of the WDR48 gene/protein.

In another embodiment the subject or the hyper-proliferative disease is characterized by one or more biomarker(s), wherein the biomarker comprise(s) one or more functional mutation(s), particularly deleterious mutation(s), of the WRN gene/protein.

In another embodiment the subject or the hyper-proliferative disease is characterized by one or more biomarker(s), wherein the biomarker comprise(s) one or more functional mutation(s), particularly deleterious mutation(s), of the XPA gene/protein.

In another embodiment the subject or the hyper-proliferative disease is characterized by one or more biomarker(s), wherein the biomarker comprise(s) one or more functional mutation(s), particularly deleterious mutation(s), of the XRCC1 gene/protein.

In another embodiment the subject or the hyper-proliferative disease is characterized by one or more biomarker(s), wherein the biomarker comprise(s) one or more functional mutation(s), particularly deleterious mutation(s), of the XRCC2 gene/protein.

In another embodiment the subject or the hyper-proliferative disease is characterized by one or more biomarker(s), wherein the biomarker comprise(s) one or more functional mutation(s), particularly deleterious mutation(s), of the XRCC3 gene/protein.

In another embodiment the subject or the hyper-proliferative disease is characterized by one or more biomarker(s), wherein the biomarker comprise(s) one or more functional mutation(s), particularly deleterious mutation(s), of the XRCC4 gene/protein.

In another embodiment the subject or the hyper-proliferative disease is characterized by one or more biomarker(s), wherein the biomarker comprise(s) one or more functional mutation(s), particularly deleterious mutation(s), of the XRCC6 gene/protein.

In another embodiment of the present invention, the subject is chemotherapy-naïve.

The term "chemotherapy-naïve" as used herein means that the subject, prior to the treatment with Compound A according to the present invention, has not received a chemotherapy.

In another embodiment of the present invention, the subject has received a chemotherapy prior to the treatment with Compound A. The term "chemotherapy" as used herein means a category of cancer treatment that uses one or more chemotherapeutic agents as part of a standardized chemotherapy regimen. Chemotherapeutic agents are rather non-specific agents including but not limited to alkylating agents, anthracyclines, taxanes, epothilones, histone deacetylase inhibitors, inhibitors of topoisomerase I, inhibitors of topoisomerase II, nucleotide analogues, platinum-based agents, vinca alkaloids.

The present invention also covers an inhibitor of ATR kinase, particularly Compound A, for use in a method of treating a hyper-proliferative disease in a subject, said method comprising the steps:
  a) determining if one or more of the biomarker(s) defined herein are present in a sample, preferably in an in vitro sample, of the subject;
  b) administering a therapeutically effective amount of the inhibitor of ATR kinase, particularly of Compound A, to the subject, if one or more of the biomarker(s) determined by step a) is (are) determined positively.

The present invention also covers an inhibitor of ATR kinase, particularly Compound A, for use in a method of treating a hyper-proliferative disease in a subject said method comprising the steps:
  a) determining if one or more of the biomarker(s) selected from
    (i) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
    (ii) the activation of the ALT pathway; and/or
    (iii) microsatellite instability, particularly high microsatellite instability; are present in a sample, preferably in an in vitro sample, of the subject;
  b) administering a therapeutically effective amount of the inhibitor of ATR kinase, particularly of Compound A, to the subject, if one or more of the biomarker(s) determined by any one of steps a)(i), a)(ii) and/or a)(iii) is (are) determined positively.

The present invention also covers an inhibitor of ATR kinase, particularly Compound A for use in a method of treating a hyper-proliferative disease in a subject said method comprising the steps:
  a) determining if one or more of the biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein are present in a sample, preferably in an in vitro sample, of the subject;
  b) administering a therapeutically effective amount of the inhibitor of ATR kinase, particularly of Compound A, to the subject, if one or more of the biomarker(s) determined by step a) is (are) determined positively.

In another embodiment of the use of an inhibitor of ATR kinase, particularly of Compound A, in a method of treating a hyper-proliferative disease in a subject according to the present invention said method comprises the steps:
  a) assaying a sample, preferably an in vitro sample, from the subject, particularly by one or more of the stratification method(s) described herein;
  b) determining if one or more of the biomarker(s) defined herein are present in the sample;
  c) administering a therapeutically effective amount of the inhibitor of ATR kinase, particularly of Compound A, to the subject, if one or more of the biomarker(s) determined by step (b) is (are) determined positively.

Particularly, the present invention covers the use of an inhibitor of ATR kinase, particularly of Compound A, in a method of treating a hyper-proliferative disease in a subject according to the present invention said method comprises the steps:
  a) assaying a sample, preferably an in vitro sample, from the subject, particularly by one or more of the stratification method(s) described herein;
  b) determining if one or more of the biomarker(s) defined in (i), (ii) and/or (iii) are present in the sample:
    (i) the one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
    (ii) the activation of the ALT pathway; and/or
    (iii) microsatellite instability, particularly high microsatellite instability;
  c) administering a therapeutically effective amount of the inhibitor of ATR kinase, particularly of Compound A, to the subject, if one or more of the biomarker(s) determined by any one of steps (b)(i), (b)(ii) and/or (b)(iii) is (are) determined positively.

In another embodiment of the use of an inhibitor of ATR kinase, particularly of Compound A, in a method of treating a hyper-proliferative disease in a subject according to the present invention said method comprises the steps:
  a) assaying a sample, preferably an in vitro sample, from the subject, particularly by one or more of the stratification method(s) described herein;
  b) determining if one or more of the biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein are present in the sample;

c) administering a therapeutically effective amount of the inhibitor of ATR kinase, particularly of Compound A, to the subject, if one or more of the biomarker(s) determined by step (b) is (are) determined positively.

In context with the present invention the term "determined positively" means that the presence of said functional mutation, said activation of the ALT pathway and/or microsatellite instability, particularly high microsatellite instability, in the sample, preferably in samples of tumor cells or tumor tissue, was confirmed, particularly by one or more of the stratification method(s) described herein.

In another embodiment the present invention covers an inhibitor of ATR kinase, particularly of Compound A, for use in a method of treating a hyper-proliferative disease in a subject, wherein said subject is selected by having one or more biomarker(s) defined herein.

In another embodiment the present invention covers an inhibitor of ATR kinase, particularly of Compound A, for use in a method of treating a hyper-proliferative disease in a subject, wherein said subject is selected by having one or more of the biomarker(s) selected from
   a) one or more functional mutation(s) in one or more gene(s)/protein(s) as defined herein;
   b) the activation of the ALT pathway; and/or
   c) microsatellite instability, particularly high microsatellite instability.

In another embodiment the present invention covers an inhibitor of ATR kinase, particularly of Compound A, for use in a method of treating a hyper-proliferative disease in a subject, wherein said subject is selected by having one or more of the biomarker(s) selected from
   a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
   b) the activation of the ALT pathway; and/or
   c) microsatellite instability, particularly high microsatellite instability.

In another embodiment the present invention covers an inhibitor of ATR kinase, particularly of Compound A, for use in a method of treating a hyper-proliferative disease in a subject, wherein said subject is selected by having one or more of the biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein.

The present invention also covers an inhibitor of ATR kinase, particularly of Compound A, for use in a method of treating a hyper-proliferative disease in a subject, wherein said hyper-proliferative disease is characterized by
   a) one or more functional mutation(s) in one or more gene(s)/protein(s) as defined herein;
   b) the activation of the ALT pathway; and/or
   c) microsatellite instability, particularly high microsatellite instability.

In another embodiment the present invention also covers an inhibitor of ATR kinase, particularly of Compound A, for the use in a method of treating a subject diagnosed with a hyper-proliferative disease, said method comprising the steps:
   a) assaying a sample, preferably an in vitro sample, from the subject, particularly by one or more of the stratification method(s) described herein;
   b) determining if one or more of the biomarker(s) defined herein are present in the sample;
   c) administering a therapeutically effective amount of the inhibitor of ATR kinase, particularly of Compound A, to the subject, if one or more of the biomarker(s) determined by step b) is (are) determined positively.

In another embodiment the present invention covers an inhibitor of ATR kinase, particularly of Compound A, for the use in a method of treating a subject diagnosed with a hyper-proliferative disease, said method comprising the steps:
   a) assaying a sample, preferably an in vitro sample, from the subject, particularly by one or more of the stratification method(s) described herein;
   b) determining if one or more of the biomarker(s) defined in (i), (ii) and/or (iii) are present in the sample:
      (i) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
      (ii) the activation of the ALT pathway; and/or
      (iii) microsatellite instability, particularly high microsatellite instability;
   c) administering a therapeutically effective amount of the inhibitor of ATR kinase, particularly of Compound A, to the subject, if one or more of the biomarker(s) determined by any one of steps (b)(i), (b)(ii) and/or (b)(iii) is (are) determined positively.

In another embodiment the present invention also covers an inhibitor of ATR kinase, particularly of Compound A, for the use in a method of treating a subject diagnosed with a hyper-proliferative disease, said method comprising the steps:
- a) assaying a sample, preferably an in vitro sample, from the subject, particularly by one or more of the stratification method(s) described herein;
- b) determining if one or more of the biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein are present in the sample;
- c) administering a therapeutically effective amount of the inhibitor of ATR kinase, particularly of Compound A, to the subject, if one or more of the biomarker(s) determined by step b) is (are) present in the sample.

In another embodiment the present invention covers the use of an inhibitor of ATR kinase, particularly of Compound A, for the preparation of a medicament for treating a hyper-proliferative disease in a subject, wherein said subject is characterized by one or more biomarker(s) defined herein.

In another embodiment the present invention covers the use of an inhibitor of ATR kinase, particularly of Compound A, for the preparation of a medicament for treating a hyper-proliferative disease in a subject, wherein said subject is characterized by
- a) one or more functional mutation(s) in one or more gene(s)/protein(s) as defined herein; and/or
- b) the activation of the ALT pathway; and/or
- c) microsatellite instability, particularly high microsatellite instability.

In another embodiment the present invention covers the use of an inhibitor of ATR kinase, particularly of Compound A, for the preparation of a medicament for treating a hyper-proliferative disease in a subject, wherein said subject is characterized by
- a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
- b) the activation of the ALT pathway; and/or
- c) microsatellite instability, particularly high microsatellite instability.

In another embodiment the present invention covers the use of an inhibitor of ATR kinase, particularly of Compound A, in the manufacture of a medicament for treating a hyper-proliferative disease in a subject, wherein said hyper-proliferative disease is characterized by one or more biomarker(s) defined herein.

In another embodiment the present invention covers the use of an inhibitor of ATR kinase, particularly of Compound A, in the manufacture of a medicament for treating a hyper-proliferative disease in a subject, wherein said hyper-proliferative disease is characterized by
- a) one or more functional mutation(s) in one or more gene(s)/protein(s) as defined herein; and/or
- b) the activation of the ALT pathway; and/or
- c) microsatellite instability, particularly high microsatellite instability.

In another embodiment the present invention covers the use of an inhibitor of ATR kinase, particularly of Compound A, in the manufacture of a medicament for treating a hyper-proliferative disease in a subject, wherein said hyper-proliferative disease is characterized by
- a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
- b) the activation of the ALT pathway; and/or
- c) microsatellite instability, particularly high microsatellite instability.

In another embodiment the present invention covers the use of an inhibitor of ATR kinase, particularly of Compound A, in the manufacture of a medicament for treating a hyper-proliferative disease in a subject, wherein said hyper-proliferative disease or said subject is characterized by one or more biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein.

In another embodiment of the use of an inhibitor of ATR kinase, particularly of Compound A, in the manufacture of a medicament for treating a hyper-proliferative disease in a subject according to the invention the one or more functional mutation(s), the activation of the ALT pathway and/or the microsatellite instability is (are) determined by one or more of the stratification method(s) described herein.

In another embodiment the present invention covers the use of an inhibitor of ATR kinase, particularly of Compound A, in the manufacture of a medicament for a method of treating a hyper-proliferative disease in a subject, said method comprising the steps:

a) assaying a sample from the subject, particularly by one or more of the stratification method(s) described herein;
b) determining if one or more of the biomarker(s) defined herein are present in the sample;
c) administering a therapeutically effective amount of the inhibitor of ATR kinase, particularly of Compound A, to the subject, if one or more of the biomarker(s) determined by step (b) is (are) determined positively.

In another embodiment the present invention covers the use of an inhibitor of ATR kinase, particularly of Compound A, in the manufacture of a medicament for a method of treating a hyper-proliferative disease in a subject, said method comprising the steps:
a) assaying a sample from the subject, particularly by one or more of the stratification method(s) described herein;
b) determining if one or more of the biomarker(s) defined in (i), (ii) and/or (iii) are present in the sample:
  (i) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
  (ii) the activation of the ALT pathway; and/or
  (iii) microsatellite instability, particularly high microsatellite instability;
c) administering a therapeutically effective amount of the inhibitor of ATR kinase, particularly of Compound A, to the subject, if one or more of the biomarker(s) determined by any one of steps (b)(i), (b)(ii) and/or (b)(iii) is (are) determined positively.

In another embodiment the present invention covers the use of an inhibitor of ATR kinase, particularly of Compound A, in the manufacture of a medicament for a method of treating a hyper-proliferative disease in a subject, said method comprising the steps:
a) determining if one or more of the biomarker(s) defined herein are present in a sample of said subject;
b) administering a therapeutically effective amount of the inhibitor of ATR kinase, particularly of Compound A, to the subject, if one or more of the biomarker(s) determined by step a) is (are) determined positively.

In another embodiment the present invention covers the use of an inhibitor of ATR kinase, particularly of Compound A, in the manufacture of a medicament for a method of treating a hyper-proliferative disease in a subject, said method comprising the steps:

a) determining if one or more of the biomarker(s) selected from
  (i) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
  (ii) the activation of the ALT pathway; and/or
  (iii) microsatellite instability, particularly high microsatellite instability; are present in a sample of said subject;
b) administering a therapeutically effective amount of the inhibitor of ATR kinase, particularly of Compound A, to the subject, if one or more of the biomarker(s) determined by any one of steps a)(i), a)(ii) and/or a)(iii) is (are) determined positively.

METHOD(S) OF THE PRESENT INVENTION

In another embodiment the present invention covers a method for the treatment of a hyper-proliferative disease in a subject using an effective amount of an inhibitor of ATR kinase, particularly of Compound A, wherein said subject or said hyper-proliferative disease is characterized by one or more biomarker(s) defined herein.

In another embodiment the present invention covers a method for the treatment of a hyper-proliferative disease in a subject using an effective amount of an inhibitor of ATR kinase, particularly of Compound A, wherein said subject is characterized by
a) one or more functional mutation(s) in one or more gene(s)/protein(s) as defined herein; and/or
b) the activation of the ALT pathway; and/or
c) microsatellite instability, particularly high microsatellite instability.

In another embodiment the present invention covers a method for the treatment of a hyper-proliferative disease in a subject using an effective amount of an inhibitor of ATR kinase, particularly of Compound A, wherein said subject is characterized by
a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC5, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
b) the activation of the ALT pathway; and/or
c) microsatellite instability, particularly high microsatellite instability.

In another embodiment the present invention covers a method for the treatment of a hyper-proliferative disease in a subject using an effective amount of an inhibitor of ATR kinase, particularly of Compound A, wherein said hyper-proliferative disease or said subject is characterized by one or more biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein.

In another embodiment of the method for the treatment of a hyper-proliferative disease in a subject using an effective amount of an inhibitor of ATR kinase, particularly of Compound A, the one or more functional mutation(s), the activation of the ALT pathway and/or the microsatellite instability is (are) determined by one or more of the stratification method(s) described herein.

The present invention also covers a method of treatment of a subject diagnosed with a hyper-proliferative disease comprising the steps
a) assaying a sample from the subject, preferably an in vitro sample from the subject, particularly by one or more of the stratification method(s) described herein;
b) determining if one or more of the biomarker(s) defined herein are present in the sample;
c) administering a therapeutically effective amount of an inhibitor of ATR kinase, particularly of Compound A, to the subject, if one or more of the biomarker(s) determined by step b) is (are) determined positively.

The present invention also covers a method of treatment of a subject diagnosed with a hyper-proliferative disease comprising the steps
a) assaying a sample from the subject, particularly by one or more of the stratification method(s) described herein;
b) determining if one or more of the biomarker(s) defined in (i), (ii) and/or (iii) are present in the sample:
  (i) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
  (ii) the activation of the ALT pathway; and/or
  (iii) microsatellite instability, particularly high microsatellite instability;
c) administering a therapeutically effective amount of an inhibitor of ATR kinase, particularly of Compound A, to the subject, if one or more of the biomarker(s) determined by any one of steps (b)(i), (b)(ii) and/or (b)(iii) is (are) determined positively.

The present invention also covers a method of treatment of a subject diagnosed with a hyper-proliferative disease comprising the steps
a) assaying a sample from the subject, preferably an in vitro sample from the subject, particularly by one or more of the stratification method(s) described herein;
b) determining if one or more of the biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein are present in the sample;
c) administering a therapeutically effective amount of an inhibitor of ATR kinase, particularly of Compound A, to the subject, if one or more of the biomarker(s) determined by step b) is (are) determined positively.

The present invention also concerns a method for identifying a subject having a hyper-proliferative disease disposed to respond favorably to an inhibitor of ATR kinase, particularly of Compound A, wherein the method comprises the detection of one or more of the biomarker(s) defined herein in a sample of said subject, preferably in an in vitro sample of tumor cells or of tumor tissue.

The present invention also concerns a method for identifying a subject having a hyper-proliferative disease disposed to respond favorably to an inhibitor of ATR kinase, particularly of Compound A, wherein the method comprises the detection of one or more of the biomarker(s) selected from:
  (ii) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
  (ii) the activation of the ALT pathway; and/or (iii) microsatellite instability, particularly high microsatellite instability;

in a sample of said subject, preferably in an in vitro sample of tumor cells or of tumor tissue.

The present invention also concerns a method for identifying a subject having a hyper-proliferative disease disposed to respond favorably to an inhibitor of ATR kinase, particularly of Compound A, wherein the method comprises the detection of one or more of the biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein in a sample of said subject, preferably in an in vitro sample of tumor cells or of tumor tissue.

In another embodiment the one or biomarker(s) is (are) determined by one or more of the stratification method(s) described herein.

The present invention also concerns a method for identifying a subject with a hyper-proliferative disease who is more likely to respond to a therapy comprising an inhibitor of ATR kinase, particularly of Compound A, than other subjects, the method comprising
  a) determining in a sample from said subject one or more of the biomarker(s) defined herein;
  b) identifying those subjects for whom in step a) one or more of the biomarker(s) is (are) determined positively.

The present invention also concerns a method for identifying a subject with a hyper-proliferative disease who is more likely to respond to a therapy comprising an inhibitor of ATR kinase, particularly of Compound A, than other subjects, the method comprising
  a) determining in a sample from said subject the biomarker(s) selected from:
    (i) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC3, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or
    (ii) the activation of the ALT pathway; and/or
    (iii) microsatellite instability, particularly high microsatellite instability; and
  b) identifying those subjects for whom one or more of the biomarker(s) of any one of a)(i), a)(ii) or a)(iii) is (are) determined positively.

The present invention also concerns a method for identifying a subject with a hyper-proliferative disease who is more likely to respond to a therapy comprising an inhibitor of ATR kinase, particularly Compound A, than other subjects, the method comprising
  a) determining in a sample from said subject one or more biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein;
  b) identifying those subjects for whom in step a) one or more of the biomarker(s) is (are) determined positively.

The present invention also concerns a method of determining whether a subject having a hyper-proliferative disease will respond to the treatment with an inhibitor of ATR kinase, particularly with Compound A, wherein the method comprises the detection of one or more of the biomarker(s) defined herein in a sample of said subject. Preferably the sample is a sample of tumor cells or of tumor tissue of said subject. Particularly, the biomarker(s) is (are) determined by one or more of the stratification method(s) described herein.

The present invention also concerns a method of determining the likelihood that a subject with a hyper-proliferative disease benefits from treatment with an inhibitor of ATR kinase, particularly with Compound A, the method comprising the detection of one or more of the biomarker(s) defined herein in a sample of said subject and identifying the subject being more likely to respond to said treatment with the inhibitor of ATR kinase, particularly with Compound A, when the one or more biomarker(s) is (are) determined positively.

The present invention also covers a method of predicting whether a subject with a hyper-proliferative disease will respond to the treatment with an inhibitor of ATR kinase, particularly with Compound A, wherein the method comprises the detection of one or more of the biomarker(s) defined herein in a sample of said subject.

The present invention also covers the use of one or more of the biomarker(s) defined herein for identifying a subject with a hyper-proliferative disease who is disposed to respond favorably to an inhibitor of ATR kinase, particularly to Compound A.

Kit(s) and Pharmaceutical Composition(s) of the Present Invention

The present invention also covers a kit comprising an inhibitor of ATR kinase, particularly Compound A, together with means, preferably a detecting agent, to detect in a sample from a subject one or more of the biomarker(s) selected from:
  a) one or more functional mutation(s) in one or more gene(s)/protein(s) selected from APC, ATG5, ARID1A, ATM, ATR, ATRIP, ATRX, BAP1, BARD1, BLM, BRAF, BRCA1, BRCA2, BRIP1, CCND1, CCNE1, CCNE2, CDC7, CDK12, CHEK1, CHEK2, DCLRE1A, DCLRE1B, DCLRE1C, DYRK1A, EGFR, ERBB2, ERBB3, ERCC2, ERCC5, ERCC4, ERCC5, FAM175A, FANCA, FANCB, FANCC, FANCD2, FANCE, FANCF, FANCG, FANCI, FANCL, FANCM, FBXO18, FBXW7, FEN1, GEN1, HDAC2, H2AFX, HRAS, KRAS, LIG4, MDC1, MLH1, MLH3, MRE11A, MSH2, MSH3, MSH6, MYC, NBN, NRAS, PALB2, PARP1, PARP2, PARP3, PARP4, PCNA, PIK3CA, PMS2, POLA1, POLB, POLH, POLL, POLN, POLQ, PRKDC, PTEN, RAD9A, RAD17, RAD18, RAD50, RAD51, RAD52, RAD54B, RAD54L, RB1, REV3L, RPA1, RPA2, SLX4, TDP1, TDP2, TMPRSS2, TMPRSS2-ERG, TOPBP1, TOP2A, TOP2B, TP53, TP53BP1, TRRAP, UBE2N, UIMC1, USP1, WDR48, WRN, XPA, XRCC1, XRCC2, XRCC3, XRCC4 and/or XRCC6 gene/protein; and/or b) the activation of the ALT pathway; and/or c) microsatellite instability, particularly high microsatellite instability.

The present invention also covers a kit comprising an inhibitor of ATR kinase, particularly Compound A, together with means, preferably a detecting agent, to detect, particularly in a sample from a subject, one or more of the biomarker(s) defined herein.

The present invention also covers a kit comprising an inhibitor of ATR kinase, particularly Compound A, together with means, preferably a detecting agent, to detect in a sample from a subject one or more biomarker(s) comprising one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N and/or XPA gene/protein.

In another embodiment the present invention covers a pharmaceutical composition comprising an inhibitor of ATR kinase, particularly Compound A, together with one or more pharmaceutically acceptable excipients for use in any of the method(s)/use(s) for treating a hyper-proliferative disease in a subject described herein.

The inhibitor of ATR kinase, particularly Compound A, can act systemically and/or locally. For this purpose, it can be administered in a suitable manner, for example by the oral, parenteral, pulmonal, nasal, sublingual, lingual, buccal, rectal, dermal, transdermal, conjunctival, otic route, or as an implant or stent. The inhibitor of ATR kinase, particularly Compound A, can be administered in administration forms suitable for these administration routes.

Suitable administration forms for oral administration are those which deliver Compound A in a rapid and/or modified manner, and contain Compound A in crystalline and/or amorphous and/or dissolved form, for example tablets (uncoated or coated tablets, for example with enteric or retarded-dissolution or insoluble coatings which control the release of Compound A, tablets or films/wafers which disintegrate rapidly in the oral cavity, films/lyophilizates, capsules (for example hard or soft gelatin capsules), sugar-coated tablets, granules, pellets, powders, emulsions, suspensions, aerosols or solutions.

Parenteral administration can be accomplished with avoidance of an absorption step (for example by an intravenous, intraarterial, intracardial, intraspinal or intralumbal route) or with inclusion of an absorption (for example by an intramuscular, subcutaneous, intracutaneous, percutaneous or intraperitoneal route). Suitable administration forms for parenteral administration include injection and infusion formulations in the form of solutions, suspensions, emulsions, lyophilizates or sterile powders.

For the other administration routes, suitable examples are pharmaceutical forms for inhalation or inhalation medicaments (including powder inhalers, nebulizers), nasal drops, solutions or sprays; tablets, films/wafers or capsules for lingual, sublingual or buccal administration, films/wafers or capsules, suppositories, ear or eye preparations (for example eye baths, ocular insert, ear drops, ear powders, ear-rinses, ear tampons), vaginal capsules, aqueous suspensions (lotions, shaking mixtures), lipophilic suspensions, ointments, creams, transdermal therapeutic systems (for example patches), milk, pastes, foams, dusting powders, implants, intrauterine coils, vaginal rings or stents.

Compound A can be converted to the administration forms mentioned. This can be done in a manner known per se, by mixing with pharmaceutically suitable excipients.

These excipients include carriers (for example microcrystalline cellulose, lactose, mannitol), solvents (e.g. liquid polyethylene glycols), emulsifiers and dispersing or wetting agents (for example sodium dodecylsulphate, polyoxysorbitan oleate), binders (for example polyvinylpyrrolidone), synthetic and natural polymers (for example albumin), stabilizers (e.g. antioxidants, for example ascorbic acid), dyes (e.g. inorganic pigments, for example iron oxides) and flavour and/or odour correctants.

Pharmaceutically acceptable excipients are non-toxic, preferably they are non-toxic and inert. Pharmaceutically acceptable excipients include, inter alia: fillers and excipients (for example cellulose, microcrystalline cellulose, such as, for example, Avicel®, lactose, mannitol, starch, calcium phosphate such as, for example, Di-Cafos®), ointment bases (for example petroleum jelly, paraffins, triglycerides, waxes, wool wax, wool wax alcohols, lanolin, hydrophilic ointment, polyethylene glycols), bases for suppositories (for example polyethylene glycols, cacao butter, hard fat)

solvents (for example water, ethanol, Isopropanol, glycerol, propylene glycol, medium chain-length triglycerides fatty oils, liquid polyethylene glycols, paraffins), surfactants, emulsifiers, dispersants or wetters (for example sodium dodecyle sulphate, lecithin, phospholipids, fatty alcohols such as, for example, Lanette®, sorbitan fatty acid esters such as, for example, Span®, polyoxyethylene sorbitan fatty acid esters such as, for example, Tween®, polyoxyethylene fatty acid glycerides such as, for example, Cremophor®, polyoxethylene fatty acid esters, polyoxyethylene fatty alcohol ethers, glycerol fatty acid esters, poloxamers such as, for example, Pluronic®), buffers and also acids and bases (for example phosphates, carbonates, citric acid, acetic acid, hydrochloric acid, sodium hydroxide solution, ammonium carbonate, trometamol, triethanolamine)

isotonicity agents (for example glucose, sodium chloride), adsorbents (for example highly-disperse silicas)

viscosity-increasing agents, gel formers, thickeners and/or binders (for example polyvinylpyrrolidon, methylcellulose, hydroxypropylmethylcellulose, hydroxypropylcellulose, carboxymethylcellulose-sodium, starch, carbomers, polyacrylic acids such as, for example, Carbopol®, alginates, gelatine), disintegrants (for example modified starch, carboxymethylcellulose-sodium, sodium starch glycolate such as, for example, Explotab®, cross-linked polyvinylpyrrolidon, croscarmellose-sodium such as, for example, AcDiSol®), flow regulators, lubricants, glidant and mould release agents (for example magnesium stearate, stearic acid, talc, highly-disperse silicas such as, for example, Aerosil®), coating materials (for example sugar, shellac) and film formers for films or diffusion membranes which dissolve rapidly or in a modified manner (for example polyvinylpyrrolidones such as, for example, Kollidon®, polyvinyl alcohol, hydroxypropylmethylcellulose, hydroxypropylcellulose, ethylcellulose, hydroxypropylmethylcellulose phthalate, cellulose acetate, cellulose acetate phthalate, polyacrylates, polymethacrylates such as, for example, Eudragit®),
capsule materials (for example gelatine, hydroxypropylmethylcellulose),
synthetic polymers (for example polylactides, polyglycolides, polyacrylates, polymethacrylates such as, for example, Eudragit®, polyvinylpyrrolidones such as, for example, Kollidon®, polyvinyl alcohols, polyvinyl acetates, polyethylene oxides, polyethylene glycols and their copolymers and blockcopolymers),
plasticizers (for example polyethylene glycols, propylene glycol, glycerol, triacetine, triacetyl citrate, dibutyl phthalate),
penetration enhancers,
stabilisers (for example antioxidants such as, for example, ascorbic acid, ascorbyl palmitate, sodium ascorbate, butylhydroxyanisole, butylhydroxytoluene, propyl gallate),
preservatives (for example parabens, sorbic acid, thiomersal, benzalkonium chloride, chlorhexidine acetate, sodium benzoate),
colourants (for example inorganic pigments such as, for example, iron oxides, titanium dioxide),
flavourings, sweeteners, flavour- and/or odour-masking agents.

The present invention further covers the use of pharmaceutical compositions which comprise the inhibitor of ATR kinase, particularly Compound A, together with one or more, preferably inert, nontoxic, pharmaceutically suitable excipients, for use in any of the method(s)/use(s) for treating a hyper-proliferative disease in a subject described herein.

Based upon standard laboratory techniques known to evaluate compounds useful for the treatment of hyper-proliferative diseases by standard toxicity tests and by standard pharmacological assays for the determination of treatment of the conditions identified above in mammals, and by comparison of these results with the results of known active ingredients or medicaments that are used to treat these conditions, the effective dosage of the compounds of this invention can be determined for treatment of each desired indication. The amount of the active ingredient to be administered in the treatment of one of these conditions can vary widely according to such considerations as the particular compound and dosage unit employed, the mode of administration, the period of treatment, the age and sex of the patient treated, and the nature and extent of the condition treated.

The total amount of the active ingredient to be administered will generally range from about 0.001 mg/kg to about 200 mg/kg body weight per day, and preferably from about 0.01 mg/kg to about 50 mg/kg body weight per day. Clinically useful dosing schedules will range from one to three times a day dosing to once every four weeks dosing. In addition, "drug holidays" in which a patient is not dosed with a drug for a certain period of time, may be beneficial to the overall balance between pharmacological effect and tolerability. A unit dosage may contain from about 0.5 mg to about 1500 mg of active ingredient, and can be administered one or more times per day or less than once a day. The average daily dosage for administration by injection, including intravenous, intramuscular, subcutaneous and parenteral injections, and use of infusion techniques will preferably be from 0.01 to 200 mg/kg of total body weight. The average daily rectal dosage regimen will preferably be from 0.01 to 200 mg/kg of total body weight. The average daily vaginal dosage regimen will preferably be from 0.01 to 200 mg/kg of total body weight. The average daily topical dosage regimen will preferably be from 0.1 to 200 mg administered between one to four times daily. The transdermal concentration will preferably be that required to maintain a daily dose of from 0.01 to 200 mg/kg. The average daily inhalation dosage regimen will preferably be from 0.01 to 100 mg/kg of total body weight.

Of course the specific initial and continuing dosage regimen for each patient will vary according to the nature and severity of the condition as determined by the attending diagnostician, the activity of the specific compound employed, the age and general condition of the patient, time of administration, route of administration, rate of excretion of the drug, drug combinations, and the like. The desired mode of treatment and number of doses of a compound of the present invention or a pharmaceutically acceptable salt or ester or composition thereof can be ascertained by those skilled in the art using conventional treatment tests.

In spite of this, it may be necessary to deviate from the amounts specified, specifically depending on body weight, administration route, individual behaviour towards the active ingredient, type of formulation, and time or interval of administration. For instance, less than the aforementioned minimum amount may be sufficient in some cases, while the upper limit mentioned has to be exceeded in other cases. In the case of administration of greater amounts, it may be advisable to divide them into several individual doses over the day.

For example, an inhibitor of ATR kinase, particularly Compound A, may be combined with known antihyperproliferative, cytostatic or cytotoxic substances for treatment of cancers. Examples of suitable antihyperproliferative, cytostatic or cytotoxic combination active ingredients include:

131I-chTNT, abarelix, abiraterone, aclarubicin, adalimumab, ado-trastuzumab emtansine, afatinib, aflibercept, aldesleukin, alectinib, alemtuzumab, alendronic acid, alitretinoin, altretamine, amifostine, aminoglutethimide, hexyl aminolevulinate, amrubicin, amsacrine, anastrozole, ancestim, anethole dithiolethione, anetumab ravtansine, angiotensin II, antithrombin III, aprepitant, arcitumomab, arglabin, arsenic trioxide, asparaginase, atezolizumab axitinib, azacitidine, basiliximab, belotecan, bendamustine, besilesomab, belinostat, bevacizumab, bexarotene, bicalutamide, bisantrene, blinatumomab, bortezomib, buserelin, bosutinib, brentuximab vedotin, busulfan, cabazitaxel, cabozantinib, calcitonine, calcium folinate, calcium levofolinate, capecitabine, capromab, carbamazepine, carboplatin, carboquone, carfilzomib, carmofur, carmustine, catumaxomab, celecoxib, celmoleukin, ceritinib, cetuximab, chlorambucil, chlormadinone, chlormethine, cidofovir, cinacalcet, cladribine, clodronic acid, clofarabine, cobimetinib, copanlisib, crisantaspase, crizotinib, cyclophosphamide, cyproterone, cytarabine, dacarbazine, dactinomycin, daratumumab, darbepoetin alfa, dabrafenib, dasatinib, daunorubicin, decitabine, degarelix, denileukin diftitox, denosumab, depreotide, deslorelin, dianhydrogalactitol, dexrazoxane, dibrospidium chloride, dianhydrogalactitol, diclofenac, dinutuximab, docetaxel, dolasetron, doxifluridine, doxorubicin, doxorubicin+estrone, dronabinol, eculizumab, edrecolomab, elliptinium acetate, elotuzumab, eltrombopag, endostatin, enocitabine, epirubicin, epitiostanol, epoetin alfa, epoetin beta, epoetin zeta, eptaplatin, eribulin, erlotinib, esomeprazole, estradiol, estramustine, ethinylestradiol, etoposide, everolimus, exemestane, fadrozole, fentanyl, filgrastim, fluoxymesterone, floxuridine, fludarabine, flutamide, folinic acid, formestane, fosaprepitant, fotemustine, fulvestrant, gadobutrol, gadoteridol, gadoteric acid meglumine, gadoversetamide, gadoxetic acid, gallium nitrate, ganirelix, gefitinib, gemcitabine, gemtuzumab, Glucarpidase, glutoxim, GM-CSF, goserelin, granisetron, granulocyte colony stimulating factor, histamine dihydrochloride, histrelin, hydroxycarbamide, I-125 seeds, lansoprazole, ibandronic acid, ibritumomab tiuxetan, ibrutinib, idarubicin, ifosfamide, imatinib, imiquimod, improsulfan, indisetron, incadronic acid, ingenol mebutate, interferon alfa, interferon beta, interferon gamma, iobitridol, iobenguane (123I), iomeprol, ipilimumab, itraconazole, ixabepilone, ixazomib, lanreotide, lansoprazole, lapatinib, lasocholine, lenalidomide, lenvatinib, lenograstim, lentinan, letrozole, leuprorelin, levamisole, levonorgestrel, levothyroxine sodium, lisuride, lobaplatin, lomustine, lonidamine, masoprocol, medroxyprogesterone, megestrol, melarsoprol, melphalan, mepitiostane, mercaptopurine, mesna, methadone, methotrexate, methoxsalen, methylaminolevulinate, methylprednisolone, methyltestosterone, metirosine, mifamurtide, miltefosine, miriplatin, mitobronitol, mitoguazone, mitolactol, mitomycin, mitotane, mitoxantrone, mogamulizumab, molgramostim, mopidamol, morphine hydrochloride, morphine sulfate, nabilone, nabiximols, nafarelin, naloxone+pentazocine, naltrexone, nartograstim, necitumumab, nedaplatin, nelarabine, neridronic acid, netupitant/palonosetron, nivolumabpentetreotide, nilotinib, nilutamide, nimorazole, nimotuzumab, nimustine, nintedanib, nitracrine, nivolumab, obinutuzumab, octreotide, ofatumumab, olaratumab, omacetaxine mepesuccinate, omeprazole, ondansetron, oprelvekin, orgotein, orilotimod, osimertinib, oxaliplatin, oxycodone, oxymetholone, ozogamicine, p53 gene therapy, paclitaxel, palbociclib, palifermin, palladium-103 seed, palonosetron, pamidronic acid, panitumumab, panobinostat, pantoprazole, pazopanib, pegaspargase, PEG-epoetin beta (methoxy PEG-epoetin beta), pembrolizumab, pegfilgrastim, peginterferon alfa-2b, pemetrexed, pentazocine, pentostatin, peplomycin, Perflubutane, perfosfamide, Pertuzumab, picibanil, pilocarpine, pirarubicin, pixantrone, plerixafor, plicamycin, poliglusam, polyestradiol phosphate, polyvinylpyrrolidone+sodium hyaluronate, polysaccharide-K, pomalidomide, ponatinib, porfimer sodium, pralatrexate, prednimustine, prednisone, procarbazine, procodazole, propranolol, quinagolide, rabeprazole, racotumomab, radotinib, raloxifene, raltitrexed, ramosetron, ramucirumab, ranimustine, rasburicase, razoxane, refametinib, regorafenib, risedronic acid, rhenium-186 etidronate, rituximab, rolapitant, romidepsin, romiplostim, romurtide, roniciclib, samarium (153Sm) lexidronam, sargramostim, satumomab, secretin, siltuximab, sipuleucel-T, sizofiran, sobuzoxane, sodium glycididazole, sonidegib, sorafenib, stanozolol, streptozocin, sunitinib, talaporfin, talimogene laherparepvec, tamibarotene, tamoxifen, tapentadol, tasonermin, teceleukin, technetium (99mTc) nofetumomab merpentan, 99mTc-HYNIC-[Tyr3]-octreotide, tegafur, tegafur+gimeracil+oteracil, temoporfin, temozolomide, temsirolimus, teniposide, testosterone, tetrofosmin, thalidomide, thiotepa, thymalfasin, thyrotropin alfa, tioguanine, tocilizumab, topotecan, toremifene, tositumomab, trabectedin, trametinib, tramadol, trastuzumab, trastuzumab emtansine, treosulfan, tretinoin, trifluridine+tipiracil, trilostane, triptorelin, trametinib, trofosfamide, thrombopoietin, tryptophan, ubenimex, valatinib, valrubicin, vandetanib, vapreotide, vemurafenib, vinblastine, vincristine, vindesine, vinflunine, vinorelbine, vismodegib, vorinostat, vorozole, yttrium-90 glass microspheres, zinostatin, zinostatin stimalamer, zoledronic acid, zorubicin.

Biomarker(s) of the Hyper-Proliferative-Disease or Subject

In another embodiment of the use(s)/method(s)/pharmaceutical composition(s)/kit(s) of the invention described herein the hyper-proliferative disease or the subject is characterized by one or more biomarker(s), wherein the biomarker(s) comprise(s) one or more deleterious mutation(s) in one or more gene(s)/protein(s) selected from BRCA1, ATM, BLM, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

In another embodiment of the use(s)/method(s)/pharmaceutical composition(s)/kit(s) of the invention described herein the hyper-proliferative disease or the subject is characterized by one or more biomarker(s), wherein the biomarker(s) comprise(s) one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

In another embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from BRCA1, ATM, BLM, ERCC5, FEN1, FANCD2, FANCG, H2AFX, PARP1, PCNA, POLL, POLB/POLL, RAD52, REV3L, TDP2, TP53BP1, UBE2N, XPA.

In another embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from BLM, BRCA1, ERCC5, FEN1, FANCD2, FANCG, H2AFX, PARP1, PCNA, POLL, POLB/POLL, RAD52, REV3L, TDP2, TP53BP1, UBE2N, XPA.

The expression "POLB/POLL" as used herein means a double mutation: one or more deleterious mutation(s) in POLB gene/protein and one or more deleterious mutation(s) in POLL gene/protein.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from BRCA1, ATM, BLM, ERCC5, FEN1, FANCD2, H2AFX, PARP1, PCNA, RAD9A, RAD17, REV3L, TP53BP1, UBE2N.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from BLM, BRCA1, ERCC5, FEN1, FANCD2, H2AFX, PARP1, PCNA, RAD9A, RAD17, REV3L, TP53BP1, UBE2N.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from ATM, BLM, BRCA1, ERCC5, FEN1, FANCD2, H2AFX, PARP1, PCNA, REV3L, TP53BP1, UBE2N.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from BLM, BRCA1, ERCC5, FEN1, FANCD2, H2AFX, PARP1, PCNA, REV3L, TP53BP1, UBE2N.

In another preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from BRCA1, ATM, FANCD2, H2AFX, RAD17, UBE2N.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from BRCA1, ATM, FEN1, H2AFX, PCNA.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in one or more gene(s)/protein(s) selected from BRCA1, FEN1, H2AFX, PCNA.

In another embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in TP53 gene/protein and one or more deleterious mutation(s) in one or more gene(s)/protein(s) selected from BLM, BRCA1, BRCA2, ERCC5, FEN1, FANCD2, FANCG, H2AFX, PARP1, PCNA, POLL, POLB/POLL, RAD9A, RAD17, RAD52, REV3L, TDP2, TP53BP1, UBE2N, XPA.

In another embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, FANCG, H2AFX, PARP1, PCNA, POLL, POLB/POLL, RAD52, REV3L, TDP2, TP53BP1, UBE2N, XPA.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, H2AFX, PARP1, PCNA, RAD9A, RAD17, REV3L, TP53BP1, UBE2N.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in TP53 gene/protein and one or more deleterious mutation(s) in one or more gene(s)/protein(s) selected from BLM, BRCA1, ERCC5, FEN1, FANCD2, H2AFX, PARP1, PCNA, REV3L, TP53BP1, UBE2N.

In a preferred embodiment of the use/method/pharmaceutical composition/kit of the invention described herein the hyper-proliferative disease or the subject is characterized by one or more biomarker(s), wherein the biomarker(s) comprise(s) one or more deleterious mutation(s) in TP53 gene/protein and one or more deleterious mutation(s) in one or more gene(s)/protein(s) selected from BRCA1, FEN1, H2AFX, PCNA.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in BLM gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in BRCA1 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in BRCA2 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in ERCC5 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in FEN1 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in FANCD2 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in FANCG gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in H2AFX gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in PARP1 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in PCNA gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in POLL gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in RAD9A gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in RAD17 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in RAD52 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in REV3L gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in TDP2 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in TP53BP1 gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in UBE2N gene/protein.

In another embodiment of the use/method/pharmaceutical composition/kit of the invention described herein the hyper-proliferative disease or the subject is characterized by one or more deleterious mutation(s) in TP53 gene/protein and by one or more deleterious mutation(s) in XPA gene/protein.

In another embodiment of the use/method/pharmaceutical composition/kit of the invention described herein the hyper-proliferative disease or the subject is characterized by one or more deleterious mutation(s) in ATM gene/protein and/or by one or more deleterious mutation(s) in BRCA2 gene/protein.

In another embodiment of the use/method/pharmaceutical composition/kit of the invention described herein the hyper-proliferative disease or the subject is characterized by one or more deleterious mutation(s) in POLL gene/protein and by one or more deleterious mutation(s) in POLB gene/protein.

In another embodiment of the use/method/pharmaceutical composition/kit of the invention described herein the hyper-proliferative disease or the subject is characterized by one or more deleterious mutation(s) in POLN gene/protein and by one or more deleterious mutation(s) in POLQ gene/protein.

In another embodiment of the use/method/pharmaceutical composition/kit of the invention described herein the hyper-proliferative disease or the subject is characterized by one or more deleterious mutation(s) in POLH gene/protein and by one or more deleterious mutation(s) in REV3L gene/protein.

In another embodiment of the use/method/pharmaceutical composition/kit of the invention described herein the hyper-proliferative disease or the subject is characterized by one or more deleterious mutation(s) in TDP1 gene/protein and by one or more deleterious mutation(s) in TDP2 gene/protein.

Prostate Cancer

In another embodiment of the use/methods/pharmaceutical compositions/kits of the present invention the hyper-proliferative disease is prostate cancer.

The term "prostate cancer" as used herein means any histology type of prostate cancer including but not limited to acinar adenocarcinoma, ductal adenocarcinoma, transitional cell (or urothelial) cancer, squamous cell cancer, carcinoid, small cell cancer, sarcomas and sarcomatoid cancers, particularly acinar adenocarcinoma, castration resistant prostate cancer (CRPC), particularly stage M0 castration-resistant prostate cancer (M0 CRPC) or stage M1 castration-resistant prostate cancer (M1 CRPC).

The terms "M0" and "M1" (including M1a, M1b, M1c) are used in accordance with the "TNM staging system" for prostate cancer developed by the American Joint Committee on Cancer as further described in "TNM CLASSIFICATION OF MALIGNANT TUMORS", 7th edition Edited by James D. Brierley, Mary K. Gospodarowicz, Christian Wittekind, Published by UICC 2011.

According to said TNM classification and as used herein the term "M0 CRPC" means, that there are no distant metastases and that the CRPC has not spread to other parts of the body. The term "M1 CRPC" as used herein means that there are distant metastases and that the CRPC has spread to distant parts of the body.

In another embodiment of the present invention, the castration resistant prostate cancer (CRPC) is stage M0 castration resistant prostate cancer (M0 CRPC) or stage M1 castration-resistant prostate cancer (M1 CRPC).

In another embodiment of the use/method/pharmaceutical composition/kit of the invention the hyper-proliferative disease is prostate cancer, particularly M0 CRPC or M1 CRPC, and the subject or the prostate cancer is characterized by one or more functional mutation(s) in one or more gene(s)/protein(s) selected from APC, ATM, ARID1A, ATG5, ATR, ATRX, BARD1, BRAF, BRCA1, BRCA2, BRIP1, CCND1, CDC7, CHEK2, DCLRE1C, DYRK1A, EGFR, ERBB3, ERCC3, ERCC5, FANCA, FANCB, FANCD2, FANCI, GEN1, HDAC, KRAS, LIG4, MLH1, MLH3, MSH2, MSH3, MSH6, MYC, NBN, PALB2, PARP4, PIK3CA, PMS2, POLA1, POLL, PRKDC, PTEN, RAD18, RAD50, RAD51, RB1, REV3L, SLX4, TMPRSS2, TMPRSS2-ERG, TOP2A, TOP2B, TP53, TP53BP1, TRRAP, UBE2N, USP1, WDR48, WRN, XPA, XRCC1 and/or XRCC2 gene/protein.

In another embodiment of the use/method/pharmaceutical composition/kit of the invention the hyper-proliferative disease is prostate cancer, particularly M0 CRPC or M1 CRPC, and the subject or the prostate cancer is characterized by one or more functional mutation(s) in one or more gene(s)/protein(s) selected from ATM, ARID1A, ATG5, ATR, ATRX, BARD1, BRAF, BRCA2, CCND1, CDC7, DCLRE1C, DYRK1A, EGFR, ERBB3, FANCA, FANCD2, FANCI, KRAS, MSH2, MSH3, MSH6, MYC, PIK3CA, POLA1, PRKDC, PTEN, RAD50, RAD51, RB1, REV3L, SLX4, TMPRSS2-ERG, TOP2A, TOP2B, TP53, TP53BP1, TRRAP, UBE2N, USP1, WDR48, WRN, XPA, XRCC1 and/or XRCC2 gene/protein.

In another embodiment of the use/method/pharmaceutical composition/kit of the invention the hyper-proliferative disease is prostate cancer, particularly M0 CRPC or M1 CRPC, and the subject or the prostate cancer is characterized by microsatellite instability, particularly high microsatellite instability.

In another embodiment of the use/method/pharmaceutical composition/kit of the invention the hyper-proliferative disease is prostate cancer, particularly M0 CRPC or M1 CRPC, and the subject or the prostate cancer is characterized by one or more functional mutation(s) in one or more gene(s)/protein(s) selected from ARID1A, ATM, ATR, ATRX, BARD1, BRAF, BRCA2, CCND1, CDC7, DCLRE1C, EGFR, ERBB3, FANCA, FANCD2, MSH2, MSH3, MSH6, MYC, PIK3CA, POLA1, PTEN, RAD50, RAD51, REV3L, SLX4, TMPRSS2-ERG, TOP2A, TOP2B, USP1, WDR48, and/or WRN gene/protein.

In another embodiment of the use/method/pharmaceutical composition/kit of the invention the hyper-proliferative disease is prostate cancer, particularly M0 CRPC or M1 CRPC, and the subject or the prostate cancer is characterized by one or more functional mutation(s) in one or more gene(s)/protein(s) selected from ARID1A, ATR, ATRX, BARD1, BRAF, BRCA2, CCND1, CDC7, DCLRE1C, EGFR, ERBB3, FANCA, FANCD2, MSH2, MSH3, MSH6, MYC, PIK3CA, POLA1, PTEN, RAD50, RAD51, REV3L, SLX4, TMPRSS2-ERG, TOP2A, TOP2B, USP1, WDR48, and/or WRN gene/protein.

In another embodiment of the use/method/pharmaceutical composition/kit of the invention the hyper-proliferative disease is prostate cancer, particularly M0 CRPC or M1 CRPC, and the subject or the prostate cancer is characterized by one or more functional mutation(s) of the ATM gene/protein, particularly by a deleterious mutation of the ATM gene/protein.

In another embodiment of the use/method/pharmaceutical composition/kit of the invention the hyper-proliferative disease is prostate cancer, particularly M0 CRPC or M1 CRPC, and the subject or the prostate cancer is characterized by one or more functional mutation(s) in at least five gene(s)/protein(s) selected from APC, ATM, ARID1A, ATG5, ATR, ATRX, BARD1, BRAF, BRCA1, BRCA2, BRIP1, CCND1, CDC7, CHEK2, DCLRE1C, DYRK1A, EGFR, ERBB3, ERCC3, ERCC5, FANCA, FANCB, FANCD2, FANCI, GEN1, HDAC, KRAS, LIG4, MLH1, MLH3, MSH2, MSH3, MSH6, MYC, NBN, PALB2, PARP4, PIK3CA, PMS2, POLA1, POLL, PRKDC, PTEN, RAD18, RAD50, RAD51, RB1, REV3L, SLX4, TMPRSS2, TMPRSS2-ERG, TOP2A, TOP2B, TP53, TP53BP1, TRRAP, UBE2N, USP1, WDR48, WRN, XPA, XRCC1 and/or XRCC2 gene/protein.

In another embodiment of the use/method/pharmaceutical composition/kit of the invention the hyper-proliferative disease is prostate cancer and the subject or the prostate cancer is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is prostate cancer and the subject or the prostate cancer is characterized by one or more biomarker(s) described in the Experimental Section for one or more of the prostate cancer cell lines, particularly the subject or the prostate cancer is characterized by one or more functional mutation(s) in one or more genes which are described in Table 5.

Ovarian Cancer

In another embodiment of the use/method/pharmaceutical compositions/kits of the present invention the hyper-proliferative disease is ovarian cancer.

In another embodiment of the use/method/pharmaceutical composition/kit of the invention the hyper-proliferative disease is ovarian cancer and the subject or the ovarian cancer is characterized by one or more functional mutation(s) in one or more gene(s)/protein(s) selected from APC, ARID1A, ATM, ATR, BRAF, BRCA1, BRCA2, CDC7, CHEK1, ERBB2, ERBB3, FANCA, FANCM, FBXW7, KRAS, MLH1, MRE11A, MSH3, MSH6, MYC, PALB2, PARP4, PIK3CA, POLH, POLN, POLQ, PRKDC, PTEN, RAD50, REV3L, TDP1, TP53, TOP2A, TOP2B and/or TOPBP1 gene/protein.

In another embodiment of the use/method/pharmaceutical composition/kit of the invention the hyper-proliferative disease is ovarian cancer and the subject or the ovarian cancer is characterized by one or more functional mutation(s) in one or more gene(s)/protein(s) selected from APC, ARID1A, ATM, ATR, BRAF, BRCA1, CDC7, CHEK1, ERBB2, ERBB3, FANCM, KRAS, MLH1, MSH6, MYC, PIK3CA, POLN, POLQ, PRKDC, PTEN, RAD50, TP53, TOP2A, TOP2B and/or TOPBP1 gene/protein.

In another embodiment of the use/method/pharmaceutical composition/kit of the invention the hyper-proliferative disease is ovarian cancer and the subject or the ovarian cancer is characterized by one or more functional mutation(s), particularly deleterious mutations, in one or more gene(s)/protein(s) selected from APC, ARID1A, ATR, BRAF, BRCA1, CDC7, CHEK1, ERBB3, FANCM, MLH1, MSH6, PIK3CA, POLN, POLQ, PRKDC, PTEN, RAD50, TOP2A, TOP2B and/or TOPBP1 gene/protein.

In another embodiment of the use/method/pharmaceutical composition/kit of the invention the hyper-proliferative disease is ovarian cancer and the subject or the ovarian cancer is characterized by one or more functional mutation(s), particularly deleterious mutations, in one or more gene(s)/protein(s) selected from APC, ATR, BRAF, CDC7, FANCM, PRKDC, TOP2B and/or TOPBP1 gene/protein.

In another embodiment of the use/method/pharmaceutical composition/kit of the invention the hyper-proliferative disease is ovarian cancer and the subject or the ovarian cancer is characterized by one or more functional mutation(s) of the ATM gene/protein, particularly by a deleterious mutation of the ATM gene/protein.

In another embodiment of the use/method/pharmaceutical composition/kit of the invention the hyper-proliferative disease is ovarian cancer and the subject or the ovarian cancer is characterized by microsatellite instability, particularly high microsatellite instability.

In another embodiment of the use/method/pharmaceutical composition/kit of the invention the hyper-proliferative disease is ovarian cancer and the subject or the ovarian cancer is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is ovarian cancer and the subject or the ovarian cancer is characterized by one or more biomarker(s) described in the Experimental Section for one or more of the ovarian cancer cell lines, particularly the subject or the ovarian cancer is characterized by one or more functional mutation(s) in one or more genes which are described in Table 5.

Colorectal Cancer

In another embodiment of the use/method/pharmaceutical compositions/kits of the present invention the hyper-proliferative disease is colorectal cancer.

In another embodiment of the use/method/pharmaceutical composition/kit of the invention the hyper-proliferative disease is colorectal cancer and the subject or the colorectal cancer is characterized by one or more functional mutation(s) in one or more gene(s)/protein(s) selected from APC, ARID1A, ATM, ATRX, BLM, BRAF, BRCA2, CDK12, CHEK2, ERBB3, ERCC3, ERCC5, FANCA, FANCM, FBXW7, FBXO18, GEN1, KRAS, MLH1, MSH2, MSH3, MSH6, MYC, NBN, PIK3CA, POLH, POLN, POLQ, PRKDC, RAD50, REV3L, SLX4, TOP2A, TOP2B, TP53, USP1, WRN and/or XRCC2 gene/protein.

In another embodiment of the use/method/pharmaceutical composition/kit of the invention the hyper-proliferative disease is colorectal cancer and the subject or the colorectal cancer is characterized by one or more functional mutation(s) in one or more gene(s)/protein(s) selected from APC, ARID1A, ATM, ATRX, BLM, BRAF, BRCA2, CHEK2, ERBB3, ERCC5, FANCA, FANCM, KRAS, MLH1, MSH2, MSH3, MSH6, MYC, NBN, PIK3CA, POLN, POLQ, PRKDC, RAD50, REV3L, SLX4, TOP2A, TOP2B, TP53, USP1 and/or XRCC2 gene/protein.

In another embodiment of the use/method/pharmaceutical composition/kit of the invention the hyper-proliferative disease is colorectal cancer and the subject or the colorectal cancer is characterized by one or more functional mutation(s) in at least three gene(s)/protein(s) selected from APC, ARID1A, ATM, ATRX, BLM, BRAF, BRCA2, CDK12, CHEK2, ERBB3, ERCC3, ERCC5, FANCA, FANCM, FBXW7, FBXO18, GEN1, KRAS, MLH1, MSH2, MSH3, MSH6, MYC, NBN, PIK3CA, POLH, POLN, POLQ, PRKDC, RAD50, REV3L, SLX4, TOP2A, TOP2B, TP53, USP1, WRN and/or XRCC2 gene/protein.

In another embodiment of the use/method/pharmaceutical composition/kit of the invention the hyper-proliferative disease is colorectal cancer and the subject or the colorectal cancer is characterized by one or more functional mutation(s) in one or more gene(s)/protein(s) selected from ARID1A, ATM, ATRX, BLM, BRAF, BRCA2, CHEK2, ERCC5, FANCA, FANCM, KRAS, MLH1, MSH2, MSH3, MSH6, MYC, NBN, PIK3CA, POLN, POLQ, PRKDC, RAD50, REV3L, SLX4, TOP2A, TOP2B, TP53, USP1 and/or XRCC2 gene/protein.

In another embodiment of the use/method/pharmaceutical composition/kit of the invention the hyper-proliferative disease is colorectal cancer and the subject or the colorectal cancer is characterized by one or more functional mutation(s) in one or more gene(s)/protein(s) selected from ARID1A, ATM, ATRX, BLM, BRAF, BRCA2, CHEK2, ERCC5, FANCA, KRAS, MLH1, MSH2, MSH3, MSH6, MYC, NBN, PIK3CA, PRKDC, RAD50, REV3L, SLX4, TOP2A, TOP2B, TP53, USP1 and/or XRCC2 gene/protein.

In another embodiment of the use/method/pharmaceutical composition/kit of the invention the hyper-proliferative disease is colorectal cancer and the subject or the colorectal cancer is characterized by one or more functional mutation(s) in one or more gene(s)/protein(s) selected from ATRX, BRAF, BRCA2, ERCC5, FANCA, MLH1, MSH3, MSH6, MYC, PIK3CA, RAD50, REV3L, SLX4, TOP2A, TOP2B, TP53 and/or USP1 gene/protein.

In another embodiment of the use/method/pharmaceutical composition/kit of the invention the hyper-proliferative disease is colorectal cancer and the subject or the colorectal cancer is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is colorectal cancer and the subject or the colorectal cancer is characterized by microsatellite instability, particularly high microsatellite instability.

In another embodiment of the use/method/pharmaceutical composition/kit of the invention the hyper-proliferative disease is colorectal cancer and the subject or the colorectal cancer is characterized by one or more biomarker(s) described in the Experimental Section for one or more of the colorectal cancer cell lines, particularly the subject or the colorectal cancer is characterized by one or more functional mutation(s) in one or more genes which are described in Table 5.

Lung Cancer

In another embodiment of the use/method/pharmaceutical compositions/kits of the present invention the hyper-proliferative disease is lung cancer.

In another embodiment of the use/method/pharmaceutical composition/kit of the invention the hyper-proliferative disease is lung cancer and the subject or the lung cancer is characterized by one or more functional mutation(s) in one or more gene(s)/protein(s) selected from ATM, ATR, BARD1, BRCA1, BRIP1, FANCD2, FANCI, CCNE1, CDK12, KRAS, MDC1, MSH3, MYC, NBN, NRAS, PIK3CA, PMS2, PRKDC, RAD50L, REV3L, SLX4, TOP2B, TP53 and/or XRCC3 gene/protein.

In another embodiment of the use/method/pharmaceutical composition/kit of the invention the hyper-proliferative disease is lung cancer and the subject or the lung cancer is characterized by one or more functional mutation(s) in one or more gene(s)/protein(s) selected from ATM, ATR, CCNE1, KRAS, MSH3, MYC, NRAS, PIK3CA, PRKDC, SLX4, TOP2B, TP53 and/or XRCC3 gene/protein.

In another embodiment of the use/method/pharmaceutical composition/kit of the invention the hyper-proliferative disease is lung cancer and the subject or the lung cancer is characterized by one or more functional mutation(s) in one or more gene(s)/protein(s) selected from ATM, ATR, CCNE1, NRAS, SLX4, TOP2B, TP53 and/or XRCC3 gene/protein In another embodiment of the use/method/pharmaceutical composition/kit of the invention the hyper-proliferative disease is lung cancer and the subject or the lung cancer is characterized by one or more functional mutation(s) in one or more gene(s)/protein(s) selected from ATM, CCNE1, KRAS, MSH3, MYC, NRAS, PRKDC, SLX4, TOP2B and/or TP53 gene/protein.

In another embodiment of the use/method/pharmaceutical composition/kit of the invention the hyper-proliferative disease is lung cancer and the subject or the lung cancer is characterized by one or more functional mutation(s) in one or more gene(s)/protein(s) selected from ATR, CCNE1, MSH3, PRKDC and/or KRAS gene/protein.

In another embodiment of the use/method/pharmaceutical composition/kit of the invention the hyper-proliferative disease is lung cancer and the subject or the lung cancer is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is lung cancer and the subject or the lung cancer is characterized by one or more biomarker(s) described in the Experimental Section for one or more of the lung cancer cell lines, particularly the subject or the lung cancer is characterized by one or more functional mutation(s) in one or more genes which are described in Table 5.

Melanoma

In another embodiment of the use/method/pharmaceutical compositions/kits of the present invention the hyper-proliferative disease is melanoma.

In another embodiment of the use/method/pharmaceutical composition/kit of the invention the hyper-proliferative disease is melanoma and the subject or the melanoma is characterized by one or more functional mutation(s) in one or more gene(s)/protein(s) selected from ATM, BRAF, PRKDC and/or XRCC3 gene/protein.

In another embodiment of the use/method/pharmaceutical composition/kit of the invention the hyper-proliferative disease is melanoma and the subject or the melanoma is characterized by one or more functional mutation(s) in one or more gene(s)/protein(s) selected from ATM, BRAF and/or PRKDC gene/protein.

In another embodiment of the use/method/pharmaceutical composition/kit of the invention the hyper-proliferative disease is melanoma and the subject or the melanoma is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is melanoma and the subject or the melanoma is characterized by one or more biomarker(s) described in the Experimental Section for one or more of the melanoma cell lines, particularly the subject or the melanoma is characterized by one or more functional mutation(s) in one or more genes which are described in Table 5.

Cervical Cancer

In another embodiment of the use/method/pharmaceutical compositions/kits of the present invention the hyper-proliferative disease is cervical cancer.

In another embodiment of the use/method/pharmaceutical composition/kit of the invention the hyper-proliferative disease is cervical cancer and the subject or the cervical cancer is characterized by one or more functional mutation(s) in one or more gene(s)/protein(s) selected from BRIP1, EGFR, REV3L and/or UIMC1 gene/protein.

In another embodiment of the use/method/pharmaceutical composition/kit of the invention the hyper-proliferative disease is cervical cancer and the subject or the cervical cancer is characterized by one or more functional mutation(s) in one or more gene(s)/protein(s) selected from EGFR and/or REV3L gene/protein.

In another embodiment of the use/method/pharmaceutical composition/kit of the invention the hyper-proliferative disease is cervical cancer and the subject or the cervical cancer is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is cervical cancer and the subject or the cervical cancer is characterized by one or more biomarker(s) described in the Experimental Section for one or more of the cervical cancer cell lines, particularly the subject or the cervical cancer is characterized by one or more functional mutation(s) in one or more genes which are described in Table 5.

Breast Cancer

In another embodiment of the use/method/pharmaceutical compositions/kits of the present invention the hyper-proliferative disease is breast cancer.

In another embodiment of the use/method/pharmaceutical composition/kit of the invention the hyper-proliferative disease is breast cancer and the subject or the breast cancer is characterized by one or more functional mutation(s) in one or more gene(s)/protein(s) selected from ATR, BLM, BRCA1, BRCA2, ERBB2, FANCA, FANCE, FANCI, FBXO18, MLH3, MSH3, MYC, PRKDC, PTEN, RB1, SLX4, TP53 and/or TMPRSS2 gene/protein.

In another embodiment of the use/method/pharmaceutical composition/kit of the invention the hyper-proliferative disease is breast cancer and the subject or the breast cancer is characterized by one or more functional mutation(s) in one or more gene(s)/protein(s) selected from ATR, BRCA1, ERBB2, FANCA, MSH3, MYC, PRKDC, PTEN, RB1, TP53 and/or TMPRSS2 gene/protein.

In another embodiment of the use/method/pharmaceutical composition/kit of the invention the hyper-proliferative disease is breast cancer and the subject or the breast cancer is characterized by one or more functional mutation(s) in one or more gene(s)/protein(s) selected from BRCA1, MSH3, MYC, PRKDC, RB1, TP53 and/or TMPRSS2 gene/protein.

In another embodiment of the use/method/pharmaceutical composition/kit of the invention the hyper-proliferative disease is breast cancer and the subject or the breast cancer is characterized by one or more functional mutation(s) in one or more gene(s)/protein(s) selected from MSH3, PTEN, RB1 and/or TP53 gene/protein.

In another embodiment of the use/method/pharmaceutical composition/kit of the invention the hyper-proliferative disease is breast cancer and the subject or the breast cancer is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is breast cancer and the subject or the breast cancer is characterized by one or more biomarker(s) described in the Experimental Section for one or more of the breast cancer cell lines, particularly the subject or the breast cancer is characterized by one or more functional mutation(s) in one or more genes which are described in Table 5.

Pancreatic Cancer

In another embodiment of the use/method/pharmaceutical compositions/kits of the present invention the hyper-proliferative disease is pancreatic cancer.

In another embodiment of the use/method/pharmaceutical composition/kit of the invention the hyper-proliferative disease is pancreatic cancer and the subject or the pancreatic cancer is characterized by one or more functional mutation(s) in one or more gene(s)/protein(s) selected from ARID1A, BRAF, DYRK1A, ERCC2, FBXW7, KRAS, MLH1, PALB2, PARP4, PRKDC and/or TP53 gene/protein.

In another embodiment of the use/method/pharmaceutical composition/kit of the invention the hyper-proliferative disease is pancreatic cancer and the subject or the pancreatic cancer is characterized by one or more functional mutation(s) in one or more gene(s)/protein(s) selected from BRAF, DYRK1A, KRAS, PRKDC and/or TP53 gene/protein.

In another embodiment of the use/method/pharmaceutical composition/kit of the invention the hyper-proliferative disease is pancreatic cancer and the subject or the pancreatic cancer is characterized by one or more functional mutation(s) in one or more gene(s)/protein(s) selected from BRAF, DYRK1A, and/or PRKDC gene/protein.

In another embodiment of the use/method/pharmaceutical composition/kit of the invention the hyper-proliferative disease is pancreatic cancer and the subject or the pancreatic cancer is characterized by one or more functional mutation(s) in one or more gene(s)/protein(s) selected from BRAF, PRKDC and/or TP53 gene/protein.

In another embodiment of the use/method/pharmaceutical composition/kit of the invention the hyper-proliferative disease is pancreatic cancer and the subject or the pancreatic cancer is characterized by one or more functional mutation(s) in one or more gene(s)/protein(s) selected from DYRK1A, KRAS, PRKDC and/or TP53 gene/protein.

In another embodiment of the use/method/pharmaceutical composition/kit of the invention the hyper-proliferative disease is pancreatic cancer and the subject or the pancreatic cancer is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is pancreatic cancer and the subject or the pancreatic cancer is characterized by one or more biomarker(s) described in the Experimental Section for one or more of the pancreatic cancer cell lines, particularly the subject or the pancreatic cancer is characterized by one or more functional mutation(s) in one or more genes which are described in Table 5.

Mantle Cell Lymphoma

In another embodiment of the use/method/pharmaceutical compositions/kits of the present invention the hyper-proliferative disease is mantle cell lymphoma.

In another embodiment of the use/method/pharmaceutical composition/kit of the invention the hyper-proliferative disease is mantle cell lymphoma and the subject or the mantle cell lymphoma is characterized by one or more functional mutation(s) in one or more gene(s)/protein(s) selected from ATM, ATR, ATRX, BAP1, BRCA1, CHEK2, DCLRE1A, ERCC2, FANCM, KRAS, MLH3, MSH3, POLN, PRKDC, RB1, SLX4, TMPRSS2 and/or TP53 gene/protein.

In another embodiment of the use/method/pharmaceutical composition/kit of the invention the hyper-proliferative disease is mantle cell lymphoma and the subject or the mantle cell lymphoma is characterized by one or more functional mutation(s) in one or more gene(s)/protein(s) selected from ATM, ATR, FANCM, KRAS, MLH3, MSH3, PRKDC, RB1, TMPRSS2 and/or TP53 gene/protein.

In another embodiment of the use/method/pharmaceutical composition/kit of the invention the hyper-proliferative disease is mantle cell lymphoma and the subject or the mantle cell lymphoma is characterized by one or more functional mutation(s) in one or more gene(s)/protein(s) selected from FANCM, KRAS, MSH3 and/or TMPRSS2 gene/protein.

In another embodiment of the use/method/pharmaceutical composition/kit of the invention the hyper-proliferative disease is mantle cell lymphoma and the subject or the mantle cell lymphoma is characterized by one or more functional mutation(s) in one or more gene(s)/protein(s) selected from FANCM, MSH3 and/or PRKDC gene/protein.

In another embodiment of the use/method/pharmaceutical composition/kit of the invention the hyper-proliferative disease is mantle cell lymphoma and the subject or mantle cell lymphoma is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is mantle cell lymphoma and the subject or the mantle cell lymphoma is characterized by one or more biomarker(s) described in the Experimental Section for one or more of the mantle cell lymphoma cell lines, particularly the subject or the mantle cell lymphoma is characterized by one or more functional mutation(s) in one or more genes which are described in Table 5.

Diffuse Large B-Cell Lymphoma (DLBCL)

In another embodiment of the use/method/pharmaceutical compositions/kits of the present invention the hyper-proliferative disease is diffuse large B-cell lymphoma.

In another embodiment of the use/method/pharmaceutical composition/kit of the invention the hyper-proliferative disease is diffuse large B-cell lymphoma and the subject or the diffuse large B-cell lymphoma is characterized by one or more functional mutation(s) in one or more gene(s)/protein(s) selected from APC, ATM, BRAF, BRIP1, CDC7, ERCC2, FANCD, FEN1, PRKDC, MLH1, MYC, REV3L, TOP2A and/or TP53 gene/protein.

In another embodiment of the use/method/pharmaceutical composition/kit of the invention the hyper-proliferative disease is diffuse large B-cell lymphoma and the subject or the diffuse large B-cell lymphoma is characterized by one or more functional mutation(s) in one or more gene(s)/protein(s) selected from ATM, BRAF, CDC7, PRKDC, MYC, TOP2A and/or TP53 gene/protein.

In another embodiment of the use/method/pharmaceutical composition/kit of the invention the hyper-proliferative disease is diffuse large B-cell lymphoma and the subject or the diffuse large B-cell lymphoma is characterized by one or more functional mutation(s) in one or more gene(s)/protein(s) selected from ATM, BRAF, CDC7, MYC, PRKDC, TOP2A and/or TP53 gene/protein.

In another embodiment of the use/method/pharmaceutical composition/kit of the invention the hyper-proliferative disease is diffuse large B-cell lymphoma and the subject or the diffuse large B-cell lymphoma is characterized by one or more functional mutation(s) in one or more gene(s)/protein(s) selected from MYC gene/protein.

In another embodiment of the use/method/pharmaceutical composition/kit of the invention the hyper-proliferative disease is diffuse large B-cell lymphoma and the subject or the diffuse large B-cell lymphoma is characterized by one or more functional mutation(s) in at least two, particularly at least three gene(s)/protein(s) selected from APC, ATM, BRAF, BRIP1, CDC7, ERCC2, FANCD, FEN1, PRKDC, MLH1, MYC, REV3L, TOP2A and/or TP53 gene/protein.

In another embodiment of the use/method/pharmaceutical composition/kit of the invention the hyper-proliferative disease is diffuse large B-cell lymphoma and the subject or the diffuse large B-cell lymphoma is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is diffuse large B-cell lymphoma and the subject or the diffuse large B-cell lymphoma is characterized by one or more biomarker(s) described in the Experimental Section for one or more of the diffuse large B-cell lymphoma cell lines, particularly the subject or the diffuse large B-cell lymphoma is characterized by one or more functional mutation(s) in one or more genes which are described in Table 5.

Glioblastoma

In another embodiment of the use/method/pharmaceutical compositions/kits of the present invention the hyper-proliferative disease is glioblastoma.

In another embodiment of the use/method/pharmaceutical composition/kit of the invention the hyper-proliferative disease is glioblastoma and the subject or the glioblastoma is characterized by one or more functional mutation(s) in one or more gene(s)/protein(s) selected from ATRX, CCNE1, ERBB2, FANCA, PRKDC, PTEN, RAD50, RAD54, TDP2 and/or TP53 gene/protein.

In another embodiment of the use/method/pharmaceutical composition/kit of the invention the hyper-proliferative disease is glioblastoma and the subject or glioblastoma is characterized by one or more functional mutation(s) in one or more gene(s)/protein(s) selected from ATRX, CCNE1, ERBB2, PRKDC, PTEN, TDP2 and/or TP53 gene/protein.

In another embodiment of the use/method/pharmaceutical composition/kit of the invention the hyper-proliferative disease is glioblastoma and the subject or glioblastoma is characterized by one or more functional mutation(s) in one or more gene(s)/protein(s) selected from CCNE1, ERBB2, PRKDC, PTEN, TDP2 and/or TP53 gene/protein.

In another embodiment of the use/method/pharmaceutical composition/kit of the invention the hyper-proliferative disease is glioblastoma and the subject or glioblastoma is characterized by one or more functional mutation(s) in one or more gene(s)/protein(s) selected from ATRX and/or PTEN gene/protein.

In another embodiment of the use/method/pharmaceutical composition/kit of the invention the hyper-proliferative disease is glioblastoma and the subject or the glioblastoma is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is glioblastoma and the subject or the glioblastoma is characterized by one or more biomarker(s) described in the Experimental Section for one or more of the glioblastoma cell lines, particularly the subject or the glioblastoma is characterized by one or more functional mutation(s) in one or more genes which are described in Table 5.

Neuroblastoma

In another embodiment of the use/method/pharmaceutical compositions/kits of the present invention the hyper-proliferative disease is neuroblastoma.

In another embodiment of the use/method/pharmaceutical composition/kit of the invention the hyper-proliferative disease is neuroblastoma and the subject or neuroblastoma is characterized by one or more functional mutation(s) in one or more gene(s)/protein(s) selected from CHEK2, MSH3 and/or PRKDC gene/protein.

In another embodiment of the use/method/pharmaceutical composition/kit of the invention the hyper-proliferative disease is neuroblastoma and the subject or the neuroblastoma is characterized by one or more functional mutation(s), particularly deleterious mutation(s), in ATM gene/protein and/or in BRCA2 gene/protein.

In another embodiment of the use/method/pharmaceutical composition/kit of the invention the hyper-proliferative disease is neuroblastoma and the subject or the neuroblastoma is characterized by one or more biomarker(s) described in the Experimental Section for one or more of the neuroblastoma cell lines, particularly the subject or the neuroblastoma is characterized by one or more functional mutation(s) in one or more genes which are described in Table 5.

Stratification Methods

Various stratification methods can be used in context of the present invention to identify one or more functional mutation(s) in one or more gene(s), an activation of the ALT pathway and/or microsatellite instability (MSI) in a sample.

Functional Mutation(s)

The determination of functional mutations, particularly of deleterious and activating mutations, of gene(s)/protein(s) is known to the person skilled in the art. Deleterious mutations and activating mutations can be, for example, determined by one or more of the following stratification methods: Next generation sequencing (NGS) (Metzker M L, "Sequencing technologies—the next generation", Nat Rev Genet. 2010; 11:31-46); Sanger sequencing and other first generation sequencing methods (Lilian T. C. Franca, Emanuel Carrilho and Tarso B. L. Kist, A review of DNA sequencing techniques, Quarterly Reviews of Biophysics 35, 2 (2002), pp. 169-200); PCR, particularly multiplex PCR; Fluorescence in situ hybridization (FISH); array comparative genomic hybridization (array CGH); single nucleotide polymorphism microarray (SNP microarrays), in particular to determine copy number variants (CNVs); or immunohistochemistry (IHC), in particular to determine the loss or overexpression of the respective protein.

The term "NGS" does not denote a single technique; rather, it refers to a diverse collection of post-Sanger sequencing technologies developed in the last decade. These methods include sequencing-by-synthesis (Ronaghi M et al., "A sequencing method based on real-time pyrophosphate", Science. 1998; 281:363-365), sequencing-by-ligation (Shendure J et al., "Accurate multiplex polony sequencing of an evolved bacterial genome", Science. 2005; 309:1728-32.16), ion semiconductor sequencing (Rothberg J M et al., "An integrated semiconductor device enabling non-optical genome sequencing.", Nature. 2011; 475:348-52.17), and others.

Bioinformatics approaches are used for detecting and analyzing the sequence variants from NGS data (Teng S, "NGS for Sequence Variants.", Adv Exp Med Biol. 2016; 939:1-20). NGS variant detection consists of quality control (to remove potential artifacts and bias from data), sequence alignment (reads are mapped to positions on a reference genome), and variant calling (which is performed by comparing the aligned reads with known reference sequences to find which segments are different with the reference genomes).

The sequence variants detected from NGS can be classified to single nucleotide variants (SNVs), small insertions and deletions (INDELs), and large structural variants (SVs) based on their sequences in length.

SNVs, the most common type of sequence variants, are single DNA basepair differences in individuals. INDELs are defined as small DNA polymorphisms including both insertions and deletions ranging from 1 to 50 bp in length. SVs are large genomic alterations (>50 bp) including unbalanced variants (deletions, insertions, or duplications) and balanced changes (translocations and inversions). Copy number variants (CNVs), a large category of unbalanced SVs, are DNA alterations that result in the abnormal number of copies of particular DNA segments.

Variant analysis includes variant annotation which can be used to determine the effects of sequence variants on genes and proteins and filter the functional important variants from a background of neutral polymorphisms.

Variant association analyses connects the functional important variants with complex diseases or clinical traits. The disease-related casual variants can be identified by combining these approaches. Results of these variant analysis are stored in public databases, such as for example COSMIC (the Catalogue Of Somatic Mutations In Cancer, www.cancer.sanger.ac.uk), ClinVar (Landrum M J, Lee J M, Riley G R, et al., "ClinVar: public archive of relationships among sequence variation and human phenotype.", Nucleic Acids Res. 2014; 42:D980-5), HGMD (Stenson P D, Mort M, Ball E V, et al., "The human gene mutation database: 2008 update.", Genome Med. 2009; 1:13) or "The Human Variome Project" (http://www.humanvariomeproject.org/), which has curated the gene-/disease-specific databases to collect the sequence variants and genes associated with diseases.

As described above, public data bases, relevant literatures and ongoing evidences associated with the recurrence and function of the gene are used to determine the reportable status of an alteration found from NGS data for the genes of interest. Functional mutations can be classified by any one of the following reportable status: deleterious mutation(s) and activation mutation(s).

Activation of the ALT Pathway

In normal somatic cells, significant telomere shortening leads to p53-dependent senescence or apoptosis (Heaphy and Meeker, J Cell Mol Med. 15(6): 1227-1238 (2011)). Cancer cells rely on telomerase or the alternative lengthening of telomeres (ALT) pathway to overcome replicative mortality. Most neoplastic cells express telomerase to support immortalization and tumor progression. However, approximately 10% to 15% of cancers achieve immortalization via a telomerase-independent mechanism of telomere lengthening, the alternative lengthening of telomeres (ALT) (Cesare A. J., Reddel R. R. Alternative lengthening of telomeres: Models, mechanisms and implications. Nat. Rev. Genet. 2010; 11:319-330.). ALT is a recombination-based mechanism of telomere maintenance characterized by heterogeneous, fluctuating telomere lengths, high levels of telomere sister chromatid exchanges (t-SCEs), abundant extrachromosomal telomeric repeat DNA (ECTR), and a specialized telomeric DNA nuclear structure termed ALT-associated promyelocytic leukemia (PML) bodies (APBs) (Robert L. Dilley, Roger A. Greenberg, ALTernative Telomere Maintenance and Cancer, Trends Cancer. 2015 Oct. 1; 1(2): 145-156). Specific mutational events including recurrent mutations of the Alpha Thalassemia/Mental Retardation Syndrome X-Linked (ATRX) or Death-Domain Associated Protein (DAXX) genes have been reported to influence ALT activation and maintenance (Amorim et al, The Role of ATRX in the Alternative Lengthening of Telomeres (ALT) Phenotype, Genes (Basel). 2016 September; 7(9): 66.). Recent studies have implicated the long-noncoding RNA telomeric repeat-containing RNA (TERRA), nuclear receptors, and RPA in the recombinogenic potential of ALT telomeres. ATR protein kinase, a critical regulator of recombination, recruited by the Replication Protein A might be involved in ALT regulation and become a viable target for treatment of ALT tumors (Flynn, R. L.; Cox, K. E.; Jeitany, M.; Wakimoto, H.; Bryll, A. R.; Ganem, N. J.; Bersani, F.; Pineda, J. R.; Suva, M. L.; Benes, C. H.; et al. Alternative lengthening of telomeres renders cancer cells hypersensitive to ATR inhibitors. Science 2015, 347, 273-277.)

Stratification methods known in the art can be used to identify subjects as having a cancer associated with activation of the ALT pathway (i.e., for identifying a cancer as associated with ALT activation, also referred to herein as an ALT cancer or an ALT+ cancer). For example, detection of maintenance of telomeres in the absence of telomerase activity (Bryan et al., EMBO J., 14:4240-4248 (1995)); detection of a pattern of telomere lengths, e.g., by terminal restriction fragment Southern blots, ranging from very short to extremely long, and with a modal length approximately twice that in comparable telomerase-positive or normal cells (Bryan et al., EMBO J., 14:4240-4248 (1995); Gollahon et al., Oncogene, 17:709-717 (1998)), detection of rapid, unsynchronized changes in telomere length cause telomere length heterogeneity (Murnane et al., EMBO J., 13:4953-4962 (1994)), detection of ALT-associated PML bodies (APBs) (Yeager et al., Cancer Res., 59:4175-4179 (1999)), detection of copying of engineered telomeric tags from one telomere to another (Pickett et al. EMBO J., 28:799-809 (2009)), detection of tandem repeat instability at telomeres and the MS32 minisatellite (Jeyapalan et al., Hum. Mol. Genet., 14: 1785-1794 (2005)), detection of Telomere-sister chromatid exchange (T-SCE) (Fan et al. Nucleic Acids Res., 37:1740-1754 (2009)), detection of an increase in the level of telomeric t-circles (Cesare et al., Mol. Cell. Biol., 24:9948-9957 (2004)), detection of single stranded C-strand telomeric DNA (ss-C-strand) (Grudic et al., Nucleic Acids Res., 35:7267-7278 (2007)), detection of C circles (Henson et al., Nat. Biotechnol., 27:1181-1185 (2009)). See, e.g. Henson and Reddel, FEBS Lett. 584(17):3800-3811 (2010); and US20150247866. In some embodiments, a branched DNA assay in RNA in situ hybridization (RNA-ISH) is used, e.g., as described in WO2015/123565.

The activation of the ALT pathway is preferably determined by one of the stratification methods described above.

Microsatellite Instability (MSI)

MSI analysis involves comparing allelic profiles of microsatellite markers generated by amplification of DNA from matching normal wildtype and test samples, which may be mismatch-repair (MMR) deficient. Alleles that are present in the test sample but not in corresponding normal wildtype samples indicate MSI.

MSI can be for example analyzed by a MSI-PCR method which includes fluorescently labelled primers for co-amplification of microsatellite markers, by MSI-immunohistochemistry (IHC) staining of four MMR pathway proteins: MLH1, PMS2, MSH2, or MSH6, or by computational methods using next generation DNA sequencing (NGS) data detecting an abnormal number of microsatellite repeats:

The term "high microsatellite instability" (herein also called "MSI-high") means that a significant number, particularly at least one, preferably at least two, of microsatellite markers were found:

MSI status can be determined by a MSI-PCR Analysis System (e.g. by Promega Corp, Madison, USA) which is based on the use of five nearly monomorphic mononucleotide microsatellite markers (BAT-25, BAT-26, NR-21, NR-24, and MONO-27). In this system high microsatellite instability ("MSI-high") is defined as the phenotype, in which at least 2 of the tested microsatellite markers (BAT-25, BAT-26, NR-21, NR-24, and MONO-27) are altered in the sample of the subject compared to a normal reference sample. Low microsatellite instability ("MSI-low") is defined as the phenotype, in which only one of the tested microsatellite markers is altered in the sample of the subject compared to a normal reference sample. Microsatellite stable (MSS) is defined as the phenotype, in which none of the tested microsatellite markers is altered in the sample of the subject compared to a normal reference sample. MSI status can also be determined by a MSI-PCR method using the five microsatellite loci (BAT-25, BAT-26, D2S123, D5S346, and D17S250) recommended by the National Cancer Institute (NCI), which are amplified in a single multiplex PCR reaction. In this system high microsatellite instability ("MSI-high") is defined as the phenotype, in which at least two of the tested mononucleotide microsatellite markers (BAT-25, BAT-26, D2S123, D5S346, and D17S250) are altered in the sample of the subject compared to a normal reference sample. Low microsatellite instability ("MSI-low") is defined as the phenotype, in which only one of the tested mononucleotide microsatellite markers (BAT-25, BAT-26, D2S123, D5S346, and D17S250) is altered in the sample of the subject compared to a normal reference sample. Microsatellite stable (MSS) is defined as the phenotype, in which none of the tested microsatellite markers (BAT-25, BAT-26, D2S123, D5S346, and D17S250) is altered in the sample of the subject compared to a normal reference sample (Boland C R, et al, A National Cancer Institute Workshop on Microsatellite Instability for cancer detection and familial predisposition: development of international criteria for the determination of microsatellite instability in colorectal cancer. Cancer Res. 1998; 58(22):5248-5257).

In this context a "normal reference sample" used for MSI testing can be for example a genomic DNA template provided by the assay kit, or DNA isolated from blood or from another non-cancerous tissue from the subject to be tested.

MSI status can be assessed by computational methods using next generation DNA sequencing (NGS) data generated from tumor or other tissues. These computational methods include but are not limited to mSINGS (Salipante, S. J. et al, "Microsatellite instability detection by next generation sequencing", Clin. Chem. 60, 1192-1199, 2014), MSISensor (Niu B et al., "MSIsensor: microsatellite instability detection using paired tumor-normal sequence data.", Bioinformatics. 2014; 30(7):1015-1016.), MANTIS (Microsatellite Analysis for Normal Tumor InStability) (Kautto E A et al, "Performance evaluation for rapid detection of pan-cancer microsatellite instability with MANTIS", Oncotarget. 2016 Dec. 12), MOSAIC (Ronald J Hause et al, "Classification and characterization of microsatellite instability across 18 cancer types", Nature Medicine 22, 1342-1350, 2016), or the Foundation Medicine NGS-MSI analysis using 114 intronic homopolymer repeat loci (10-20 bp long in the human reference genome) (Michael J. Hall et al, J Clin Oncol 34, 2016 (suppl 4S; abstr 528).

In these computational methods MSI status can be defined by cutoff numbers for MSI-high, MSI-low or MSS based on an index score for each sample determined by using computer algorithm and validated by comparing to the other MSI detection methods.

MSI can also be detected by an immunohistochemistry (IHC) staining of four microsatellite marker proteins: MLH1, PMS2, MSH2, or MSH6. If any of these four proteins are found significantly reduced in quantity by IHC, particularly if at least one of the four proteins cannot be detected by IHC, the sample is labeled as MSI-high.

In another embodiment of the use/method/pharmaceutical composition/kit of the present invention the microsatellite instability is characterized by the alteration of one or more, preferably of two or more, microsatellite markers selected from BAT-25, BAT-26, NR-21, NR-24, MONO-27, D2S123, D5S346, D17S250 in the sample of the subject compared to a normal reference sample and/or microsatellite instability is characterized by the absence of one or more proteins selected from MLH1, PMS2, MSH2 and/or MSH 6.

In another embodiment of the use/method/pharmaceutical composition/kit of the present invention the microsatellite instability is characterized by the alteration of one or more, preferably of two or more, microsatellite markers selected from BAT-25, BAT-26, NR-21, NR-24, MONO-27, D2S123, D5S346 and/or D17S250 in the sample of the subject compared to a normal reference sample.

In another embodiment of the use/method/pharmaceutical composition/kit of the present invention the microsatellite instability is characterized by the alteration of one or more, preferably of two or more, microsatellite markers selected from BAT-25, BAT-26, NR-21, NR-24 and/or MONO-27 in the sample of the subject compared to a normal reference sample.

In another embodiment of the use/method/pharmaceutical composition/kit of the present invention the microsatellite instability is characterized by the alteration of at least one, preferably of at least two, microsatellite markers selected from BAT-25, BAT-26, NR-21, NR-24, and MONO-27 in the sample of the subject compared to a normal reference sample.

In another embodiment of the use/method/pharmaceutical composition/kit of the present invention the microsatellite instability is characterized by the alteration of one or more microsatellite markers selected from BAT-25, BAT-26, D2S123, D5S346 and/or D17S250 in the sample of the subject compared to a normal reference sample.

In another embodiment of the use/method/pharmaceutical composition/kit of the present invention the microsatellite instability is characterized by the alteration of at least one, preferably of at least two, microsatellite markers selected from BAT-25, BAT-26, D2S123, D5S346 and/or D17S250 in the sample of the subject compared to a normal reference sample.

In another embodiment of the use/method/pharmaceutical composition/kit of the present invention the microsatellite instability is characterized by the absence of one or more proteins selected from MLH1, PMS2, MSH2 and/or MSH 6.

In another embodiment is determined by immunohistochemistry staining of MMR pathway proteins (MLH1, PMS2, MSH2, or MSH6). In this method the "MSI-high" phenotype is characterized by a significant reduction in quantity of one or more of the proteins selected from MLH1, PMS2, MSH2, and/or MSH6, particularly by a loss of expression of at least one of the proteins selected from MLH1, PMS2, MSH2 and/or MSH6. In this context the term "loss of expression" means no positive nuclear staining in a tumor cell, particularly in a tumor cell, by IHC.

The percentages in the tests and examples which follow are, unless indicated otherwise, percentages by weight; parts are parts by weight. Solvent ratios, dilution ratios and concentration data for liquid/liquid solutions are based in each case on volume.

EXPERIMENTAL SECTION

Preparation of Compound A

Compound A was prepared according to the procedure described in example 111 of International Patent Application WO2016020320.

Example 1

Treatment of Different Prostate Cancer Cell Lines with Compound A

LAPC-4 human prostate cancer cells were obtained from the VTT Technical Resarch Center (Finland). They were plated in RPMI 1640 (RPMI=Roswell Park Memorial Institute) medium without phenol red+10% charcoal-stripped FCS (FCS=Fetal Calf Serum)+2 mM L-Glutamine at 4000 cells/well in a 96-well microtiter plate. After 1 day, the cells were treated with R1881 (1 nM) and Compound A (day 0). Cell number was determined by Alamar Blue staining (2 h) at day 7. Fluorescence was determined in a Victor X3 device (excitation 530 nm; emission 590 nm). The inhibition of cell growth was calculated by normalization with respect to the fluorescence reading (cell number) measured at the end of the experiment for cells treated with R1881 alone compared to the fluorescence reading (cell number) measured at the end of the experiment for DMSO-treated cells.

VCaP human prostate cancer cells were obtained from the VTT Technical Research Center (Finland). They were plated in DMEM medium (DMEM=Dulbecco's Modified Eagle Medium) with stable glutamine+10% FCS at 16000 cells/well in a 96-well microtiter plate. Compound A was added at day 0. Cell number was determined by Alamar Blue staining (2 h) at day 0 and day 7. Fluorescence was determined in a Victor X3 device (excitation 530 nm; emission 590 nm). The inhibition of cell growth was calculated by normalization with respect to the fluorescence reading (cell number) measured at the end of the experiment for cells treated with R1881 alone compared to the fluorescence reading (cell number) measured at the start of the experiment for DMSO-treated cells.

LNCaP human prostate cancer cells were obtained from the DSMZ-German Collection of Microorganisms and Cell Cultures (Germany) (DSMZ ACC-256). They were plated in RPMI1640 medium without phenol red+10% charcoal-stripped FCS at 600 cells/well in a 384-well white plate. R1881 (1 nM) and Compound A were added at day 0. Cell number was determined by CellTiter-Glow (Promega) at day 0 and day 6. Luminescence was determined in Victor X3. The inhibition of cell growth was calculated by normalization with respect to the fluorescence reading (cell number) measured at the end of the experiment for cells treated with R1881 alone compared to the fluorescence reading (cell number) measured at the start of the experiment for DMSO-treated cells.

22RV1 human prostate cancer cells were obtained from the American Type Culture Collection (ATCC CRL-2505). They were plated in RPMI1640 medium supplemented with 10% FCS at 5000 cells/well in a 96-well microtiter plate. After 24 h, the cells from one microtiter plate were stained with crystal violet (==>0 plate), whereas the cells in the test plates were exposed continuously for 4 days to test substances. Cell proliferation was determined by staining with crystal violet. The absorbance was determined photometrically at 595 nm using a Tecan Sunrise instrument. The percentage change of cell growth was calculated by normalization with respect to the absorbance reading (cell number) at the beginning of treatment of cells (0 plate) and the absorbance reading (cell number) of the untreated control group.

DU-145 human prostate cancer cells were obtained from the DSMZ-German Collection of Microorganisms and Cell Cultures (Germany) (DSMZ ACC-261). They were plated in DMEM/Ham's F12 medium at 5000 cells/well in a 96-well microtiter plate. After 24 h, the cells from one microtiter plate were stained with crystal violet (==>0 plate), whereas the cells in the test plates were exposed continuously for 4 days to test substances. Cell proliferation was determined by staining with crystal violet. The absorbance was determined photometrically at 595 nm using a Tecan Sunrise instrument. The percentage change of cell growth was calculated by normalization with respect to the absorbance reading (cell number) at the beginning of treatment of cells (0 plate) and the absorbance reading (cell number) of the untreated control group.

PC-3 human prostate cancer cells were obtained from the DSMZ-German Collection of Microorganisms and Cell Cultures (Germany) (DSMZ ACC-465). They were plated in DMEM/Ham's F12 medium with stable Glutamine+10% FCS at 5000 cells/well in a 96-well microtiter plate. After 24 h, the cells from one microtiter plate were stained with crystal violet (==>0 plate), whereas the cells in the test plates were exposed continuously for 4 days to test substances. Cell proliferation was determined by staining with crystal violet. The absorbance was determined photometrically at 595 nm using a Tecan Sunrise instrument. The percentage change of cell growth was calculated by normalization with respect to the absorbance reading (cell number) at the beginning of treatment of cells (0 plate) and the absorbance reading (cell number) of the untreated control group.

Treatment of Further Cancer Cell Lines with Compound A

The cells (See Table 3: Test systems) were seeded in their appropriate medium supplemented with 10% FCS at 1,250-5,000 cells/well (depending on their proliferation rate) in 96-well microtiter plates. Cells were allowed to adhere for 24 h, and then the compound was added using a digital dispenser. The final concentration of Compound A was between 1E-09 mol/L and 3E-06 mol/L, and the final concentration of the solvent DMSO was 0.03%. After 4 days of continuous incubation, the cells were fixed with glutaraldehyde, stained with crystal violet, and the absorbance was recorded at 595 nm. All measurements were done in quadruplicates. The values were normalized to the absorbance of solvent treated cells (=100%) and the absorbance of a reference plate which was fixed at the time point of compound application (=0%). Half-maximal growth inhibition ($IC_{50}$) was determined as compound concentration, which was required to achieve 50% inhibition of cellular growth using a 4-parameter fit.

Non-adherent growing GRANTA-519, Jeko-1, JVM-2, NCI-H929, Rec-1 and SU-DHL-8 cells were seeded in 150 µl of growth medium at 4000 cells/well (NCI-H929, 5000 cells/well) in 96-well microtiter plates and incubated for 24 h at 37° C. Compound A was added using a digital dispenser to the cells in the test plates and incubated continuously for 4 days at 37° C. To determine cell viability (corresponding to cell number) CTG solution (Promega Cell Titer Glo solution, #G755B and G756B) was added. After incubation for further 10 min luminescence was measured using Perkin Elmer Victor V equipment. All measurements were done in quadruplicates. The percentage change of cell viability was calculated by normalization with respect to the luminescence reading (cell number) at the beginning of treatment of cells (a reference plate was measured at the time point of compound application to the measurement plates) and the luminescence reading (cell number) of the untreated control group. Half-maximal growth inhibition ($IC_{50}$) was determined as compound concentration, which was required to achieve 50% inhibition of cellular growth using a 4-parameter fit.

Treatment of Isogenic Cancer Cell Lines with Compound A

The isogenic DLD-1 cell lines DLD-1 parental, DLD-1 BRCA2 (−/−) and DLD-1 ATM (−/−) (see Table 3: Test systems) were seeded in RPMI 1640 (RPMI=Roswell Park Memorial Institute) medium without phenol red+10% charcoal-stripped FCS (FCS=Fetal Calf Serum)+2 mM L-Glutamine+25 mM Sodium Bicarbonate at 2,500 cells/well in a 96-well microtiter plate. Cells were allowed to adhere for 24 h, and then the compound was added using a digital dispenser. The final concentration of Compound A was between 7E-10 mol/L and 5E-06 mol/L, and the final concentration of the solvent DMSO was 0.03%. After 7 days of continuous incubation at 37° C. cell viability was determined (corresponding to cell number) using CTG solution (Promega Cell Titer Glo solution, #G755B and G756B) was added. After incubation for further 10 min luminescence was measured using Perkin Elmer Victor V equipment. All measurements were done in quadruplicates. The percentage change of cell viability was calculated by normalization with respect to the luminescence reading (cell number) at the beginning of treatment of cells (a reference plate was measured at the time point of compound application to the measurement plates) and the luminescence reading (cell number) of the untreated control group. Half-maximal growth inhibition (IC50) was determined as compound concentration, which was required to achieve 50% inhibition of cellular growth using a 4-parameter fit.

TABLE 3

Test systems

| Cell line | Tumor entity | Source |
|---|---|---|
| A2780 | ovarian carcinoma | ECACC-93112519 |
| AsPC1 | pancreatic carcinoma | ATCC CRL-1682 |
| BxPC3 | pancreatic carcinoma | ATCC CRL-1687 |
| Caco2 | colorectal carcinoma | DSMZ ACC-169 |
| GRANTA-519 | mantle cell lymphoma | DSMZ ACC-342 |
| DLD-1 (parental) | colorectal carcinoma | HD PAR-008 |
| DLD-1 BRCA2 (−/−) | colorectal carcinoma | HD 105-007 |
| DLD-1 ATM (−/−) | colorectal carcinoma | HD 105-061, clone 11517 |
| HeLa | human cervical adenocarcinoma | ATCC CCL-2 |
| HT-144 | malignant melanoma | ATCC HTB-63 |
| HT-29 | colorectal carcinoma | DSMZ ACC-299 |
| Jeko-1 | mantle cell lymphoma | DSMZ ACC-553 |
| LOVO | colorectal carcinoma | DSMZ ACC-350 |
| MDA-MB-436 | mammary carcinoma | CLS 300278 |
| MDA-MB-468 | mammary carcinoma | ATCC HTB-132 |
| MIAPaca-2 | pancreatic carcinoma | ATCC CRL-1420 |
| NCI-H460 | non-small cell lung carcinoma | ATCC HTB-177 |
| NCI-H929 | multiple myeloma | ATCC CRL-9068 |
| OVCAR-8 | ovarian carcinoma | NCI-60 panel; Sample ID No. 25 |
| REC-1 | mantle cell lymphoma | ATCC CRL-3004 |
| SK-OV-3 | ovarian carcinoma | ATCC HTB-77 |
| SU-DHL-8 | germinal center B cell DLBCL | DSMZ ACC-573 |
| JVM-2 | mantle cell lymphoma | ATCC CRL-3002 |
| TMD-8 | activated B cell DLBCL | Charite, Berlin, Germany |
| C4-2B | prostate cancer | MD Anderson Cancer Center |
| HCT116 | colorectal carcinoma | DSMZ ACC-581 |
| IGR-OV-1 | ovarian carcinoma | NCI-60 panel; Sample ID No. 26 |
| NCI-H23 | non-small cell lung carcinoma | ATCC CRL-5800 |
| NCI-H1838 | non-small cell lung carcinoma | ATCC CRL-5899 |
| NCI-H1703 | non-small cell lung carcinoma | ATCC CRL-5889 |
| A549 | non-small cell lung carcinoma | DSMZ ACC-107 |
| NCI-H2030 | non-small cell lung carcinoma | ATCC CRL-5914 |
| HCC70 | mammary carcinoma | ATCC CRL-2315 |
| M059J | glioblastoma | ATCC CRL-2366 |
| U-87MG | glioblastoma | ATCC HTB-14 |
| SH-SY5Y | neuroblastoma | ATCC CRL-2266 |

ATCC = American Type Culture Collection;
NCI = National Cancer Institute;
CLS = Cell Line Service GmbH, Germany;
DSMZ = Deutsche Sammlung von Mikroorganismen and Zellkulturen GmbH, Germany;
MD Anderson Cancer Center, Houston, USA;
HD = Horizon Discovery Ltd Results:

The genetic mutations and DNA copy number alterations of the above-mentioned cancer cell lines were determined by targeted whole exome sequencing testing and/or acquired from the public databases of Cancer Cell Line Encyclopedia (CCLE, Barretina, Caponigro, Stransky et al. The Cancer Cell Line Encyclopedia enables predictive modelling of anticancer drug sensitivity. Nature. 2012 28; 483(7391):603-7.), Genentech Panel (Klijn C, Durinck S, Stawiski E W, Haverty P M, Jiang Z, et al, A comprehensive transcriptional portrait of human cancer cell lines. Nat Biotechnol. 2015 March; 33(3):306-12.) and Sanger Cell Line Panel in COSMIC database (www.cancer.sanger.ac.uk; "COSMIC: exploring the world's knowledge of somatic mutations in human cancer", Forbes et al., Nucleic Acids Res. 2015, January; 43 (Database issue):D805-11. doi: 10.1093/nar/gku1075. Epub 2014 Oct. 29).

Mutations in DNA damage (DDR) or mismatch repair (MMR) genes as well as mutations in genes inducing oncogenic replication stress or in TP53/tumor suppressor genes of these cancer cell lines (Table 3) are listed in Table 4, selected functional mutations of these cell lines are described in Table 5.

The activity of Compound A in these cell lines was tested. As shown in Table 4, Compound A inhibited the proliferation of the tumor cell lines tested. These results demonstrate that Compound A potently inhibits the proliferation of human tumor cell lines when tested as single agent and that the genetic background of the cells impacts their sensitivity to ATR inhibition.

The activity of Compound A was also tested in isogenic cell lines, in the parental DLD-1 cells and in two DLD-1 cell clones that are deficient for BRCA2 or ATM: DLD-1 BRCA2 (−/−) and DLD-1 ATM (−/−). As shown in Table 6, Compound A inhibited the proliferation of the parental DLD-1 to a lesser extent than the mutant cell lines. The strongest effect was detectable in ATM deficient DLD-1 cells. These results demonstrate that mutations in the genes BRCA2 and ATM sensitize tumor cells to treatment with Compound A.

TABLE 4

| | | | Inhibition of tumor cell proliferation by Compound A | |
|---|---|---|---|---|
| Indication | Cell line | DDR/MMR defects | Oncogenic replication stress or TP53/tumor suppressors | in vitro (IC50, nM) |
| Prostate | LNCaP | ARID1Afs, ATG5fs, ATMA1119V/K1572N, ATRXEE2264-2265E, BRCA2fs, CHEK2T430N, ERCC3A740T; R391W, ERCC5L1023I, FANCAE369D, Q652*, HDAC2A62V, MLH3I541V, MSH3PPA66-68-; fs, POLBfs, POLHD631G, PRKDCfs, RAD50fs, RAD54LL532M, RB1splice_acceptor, SLX4S605N, TDP2T308S, TP53BP1R639Q; Q111*, TRRAPR2665W; P3554L, WDR48G107*, XRCC3P87L, XRCC4L70M | APCR2714C, ATRK1379N, ERBB3K177N, MYCN45S, PTENfs, TOP2Afs, TOP2BG323*/V889A | 18 |
| Prostate | 22Rv1 | ATMK1101E, ARID1Afs, BARD1fs, BRCA2V1810I, fs, DCLRE1Cfs, FANCAfs, MSH3fs, NBNR43Q, PALB2V1123M, PARP4R970W, PRKDCfs, RAD18L314V, RAD50T532I, SLX4fs, TP53BP1fs, USP1fs, WRNfs, XRCC2fs | PIK3CAQ546R, ATRfs, BRAFL597R, ERBB3R683Q, TP53Q331R | 36 |
| Prostate | VCaP | MSH3PPA66-68-, MSH6fs | CCND1S219N, TMPRSS2-ERG, MYCamp, TP53R248W | 51 |
| Prostate | LapC4 | ARID1A-2138-2139X, BAP1P723L, BRCA2fs, CDK12W1459X, ERCC2E313K, ERCC3R642Q/V443A/E259D, ERCC5G1080R, FANCD2N405S, P714L, P1081X, splice_donor, GEN1K42E, H2AFXN95S, LIG4T219A, MLH3K585X, MSH2M300R, splice_donor, MSH3K381X, PALB2V398A, PARP1W589C, PARP3H441R, PARP4T1170I, V1065A, Q1059R, I1039T, V626D, POLHD140N, POLQS1797I, M587I, PRKDCQ4041H, RAD17R49X, RAD51C320Y, RAD54BI164T, REV3LS2862T, P2172L, TRRAPD394G, M1087I, P2026L, H3174Y, A3655V, WDR48S611P, WRNE3X, K1126X | ATRR1951*stop/amp, CDC7A342V/D571G, EGFRV980D, TP53H178PX, R175H | 55 |
| Prostate | DU-145 | ATG5splice_donor, BRCA1E962K, BRCA2S2284L, BRIP1T132N, DYRK1AR226H, FANCBG702W, FANCIfs, GEN1Q554H, LIG4R32C, MLH1A586V, splice, MSH2L736I, MSH6S1067I, PMS2H189Y, POLA1A550S, POLLA285T, POLQV124M, PRKDCfs, RAD50N509K, RB1K715*, REV3LR2523C, RPA2E252D, TP53BP1splice_acceptor, TRRAPfs; A1389T, UIMC1A96D, UBE2Nfs, USP1fs, XPAfs, XRCC1splice_acceptor, XRCC2fs | KRASamp, DYRK1R226H, TMPRSS2splice_acceptor, TP53V274F; P223L | 110 |
| Prostate | PC3 | MSH3AAAAAAAAPP55-64A; PPA66-68, PRKDCfs | MYCamp, TP53fs | 490 |
| Prostate | C4-2B | MSI-H, ARID1A_c.854delG_p.G285fs*78, ATRX-E2265del, MSH2loss, TRRAP-Q1984* | PTENdel | 50 |
| Breast | HCC70 | MSH3PPA66-68-, RB1DN479-480D | PTENfs, TP53R248Q | 27 |
| Breast | MDA-MB-436 | BRCA1splice_donor, FANCIS812G, MLH3F92L, PRKDCL1824F; fs, | TMPRSS2V101F, MYCamp+, TP53fs | 120 |
| Breast | MDA-MB-468 | BLMD554V, BRCA2M965I, FANCAQ869*, FANCEG245-, FBXO18G193A, SLX4E1784Q | ERBB2fs, ATRP? (2633 + 5A > G, Substitution – intronic) PTENsplice_donor, TP53R273H | 130 |

TABLE 4-continued

Inhibition of tumor cell proliferation by Compound A

| Indication | Cell line | DDR/MMR defects | Oncogenic replication stress or TP53/tumor suppressors | in vitro (IC50, nM) |
|---|---|---|---|---|
| Cervix | HeLa | BRIP1R855H, REV3LQ2891*, UIMC1R536W | EGFRI646L | 150 |
| Colorectal | LOVO | MSI-H, ARID1A-F2141fs*59, ATM-splice site 1236-2__1237delAGGC, CHEK2-T389fs*25, ERCC3Q711R, FANCAR350W, FBXW7R505C, MSH2-G71del, MSH3L795H, NBNfs, POLHT477I, BLMfs, POLQfs, PRKDCfs, RAD50fs, XRCC2-L117fs*17 | APCR1114*; R2816Q; fs, KRASG13D | 71 |
| Colorectal | HT29 | FANCMfs, POLNR761*, POLQS1819*, PRKDCfs, WRNL1255V | APCE853*, fs, MYCamp, BRAFV600E, T119S, PIK3CAP449T, TP53R273H | 160 |
| Colorectal | Caco2 | none | APCQ1367*, ERBB3D857N | 240 |
| Colorectal | HCT-116 | ATMA1127V, ATRXTK1529-1530K, BRCA2fs, CDK12P250H, CHEK2L398P, ERCC5splice_donor, FANCAfs, FBXO18A1062V, GEN1R401Q, MLH1S252*, MSH3fs, MSH6fs, POLHA112T, POLQK2571N, PRKDCY2964C, RAD50fs, REV3Lfs, SLX4A1461fs*2, TRRAPH3023Y; T3663A, USP1R180*, WRNE480V | ERBB3Q261*, TOP2Afs, TOP2BR651H, KRAS G13D, PIK3CA H1047R | 25 |
| Glioblastoma | U-87MG | RAD50D515G, RAD54LR691Q | ATRXN564S PTENsplice_donor, | 64 |
| Glioblastoma | M059J | FANCAR1409W, PRKDCfs, RAD54BP98L, TDP2R317* | CCNE1R95L, ERBB2W452S PTENfs, TP53E286K | 80 |
| Lung | NCI-H1838 | ATMW1279*, BRCA1C328Y, CDK12R1473Q, RAD50L347P, MSH3AAAAAAAAPP55-64A; PPA66-68-, PRKDCfs | ATRP1991S, TP53R273L | 24 |
| Lung | NCI-H1703 | ATMV1521L; G1998E, BRCV1G890V, FANCD2V97I, MSH3AAAAAAAAPP55-64A; PPA66-68-, PRKDCTs | TP53splice_donor | 46 |
| Lung | NCI-H460 | NBNG224A, REV3LQ1367L, MSH3AAAAAAAAPP55-64A, PRKDCfs | KRASQ61H, PIK3CAE545K, MYCamp | 65 |
| Lung | NCI-H2030 | MSH3AAAAAAAAPP55-64A; PPA66-68-, PRKDCfs | KRASG12C, TP53G262V | 160 |
| Lung | NCI-H23 | ATMQ1919P, BARD1A168T, BRIP1E1054A, FANCID1048Y, MSH3E251*, MDC1N1233S, NBNV153I, PMS2E491K, PRKDCfs, SLX4ED1148-1149D | CCNE1D83N, KRASG12C/amp, TOP2BH977Y, MYCamp, NRASamp, TP53M246I | 18 |
| Lung | A549 | ATRsplice_acceptor, MSH3PPA66-68-, PRKDCfs | KRASG12S, ATRsplice, CCNE1amp | 29 |
| Lymphoma, B cell | SU-DHL-8 | ATMK1964E, FANCD2R1165Q, FEN1L190V, REV3LV1004E, PRKDCfs | MYCp72S, Q10H, BRAFT599TT, CDC7K42N, TOP2AG1197E, TP53R249G; Y234N | 9 |
| Lymphoma, B cell | TMD-8 | BRIP1S59P, ERCC2H148R, MLH1V16L | APCK1170E, MYCF3L | 179 |
| Lymphoma, mantle cell | REC-1 | ATMS707P/amp, PRKDCK3872R; fs, POLNN382S | KRASamp, TP53Q317*; G245D | 10 |
| Lymphoma, mantle cell | Jeko-1 | ATMamp, ATRXR246C, BAP1S609G, BRCA1N742S, CHEK2V218A, DCLRE1AR1002C, ERCC2V231M, MLH3I397-, PRKDCfs, RB1R621S, SLX4G395C | ATRT1751A, TMPRSS2Y82D, TP53fs | 18 |
| Lymphoma, mantle cell | GRANT A-519 | ATMR2832C | none | 30 |
| Lymphoma, mantle cell | JVM-2 | FANCMQ1701*, MSH3AAAAAAAAPP55-64A, PRKDCfs | none | 32 |

TABLE 4-continued

Inhibition of tumor cell proliferation by Compound A

| Indication | Cell line | DDR/MMR defects | Oncogenic replication stress or TP53/tumor suppressors | in vitro (IC50, nM) |
|---|---|---|---|---|
| Melanoma | HT-144 | ATMW2845*, PRKDCfs, XRCC3E278K | BRAFV600E | 40 |
| Neuroblastoma | SH-SY5Y | CHEK2fs, MSH3PPA66-68-, PRKDCfs | none | 13 |
| Ovarian | A2780 | ARID1AQ1430*, R1721fs*4, ATMP604S, FANCMfs, PARP4G630E, POLHR356Q, PRKDCfs | ATRI123V, ERBB3V1082I, PTENK128_R130del, TOP2BV530I, BRAFV226M, PIK3CAE365K | 21 |
| Ovarian | SK-OV-3 | ARID1AQ586*, ATMsplice_acceptor, FANCMA205V, FBXW7R505L, TDP1Y46C | APCfs, TOPBP1N295S, PIK3CAH1047R, KRASamp, CDC7del, TP53fs | 33 |
| Ovarian | IGROV-1 | MSI-H, ARID1AD1850fs*4, G276fs*87, ATMR248Q, BRCA1K654fs*47, BRCA2P3150T, CHEK1fs, FANCA3prime_UTR, MLH1S505fs*3, MRE11AR525K, MSH3G539V; F780L; D943N, MSH6fs, PALB2T787I, POLQfs; L45I, POLNfs, PRKDCC1454Y, Y155C, RAD50fs, RAD52E130K, RB1fs, TDP1N179S, TRRAPS2051F, USP1V636I, UIMC1A418T | ERBB3K742, PIK3CAR38C; *1069W, PTENfs, TOP2AH605Q, TOPBP1D395G, TP53Y126C | 96 |
| Ovarian | OVCAR8 | ATMV613L, MSH6T727S, REV3LL3040V | APCA1225S, ERBB2G776V, KRASP121H, MYCamp, TP53splice_acceptor | 110 |
| Pancreas | BxPC3 | ERCC2R156Q, PRKDCfs | BRAFVTAPTP487-492A, TP53Y220C | 44 |
| Pancreas | AsPc-1 | FBXW7R465C, PARP4M1110L, PRKDCfs | DYRK1AS14C, KRASG12D, TP53fs | 49 |
| Pancreas | MIAPaCa2 | ARID1AP1940L, MLH1T270I, PALB2S64L | KRASG12C, TP53R248W | 380 |

TABLE 5

Functional mutations of genes of tested cell lines

| | | | Functional Mutation | |
|---|---|---|---|---|
| Indication | Cell line | DDR/MMR deleterious | TP53/tumor suppressors | oncogenic replication stress |
| Prostate | LNCaP | ARID1Afs, ATGfs, ATRXEE2264-2265E, BRCA2fs, FANCAE369D, Q652*, MSH3PPA66-68-; fs, PRKDCfs, RAD50fs, RB1splice_acceptor, WDR48G107* | TP53BP1R639Q; Q111* | ATRK1379N, ERBB3K177N, MYCN45S, TOP2Afs, TOP2BG323*/V889A |
| Prostate | 22Rv1 | ARID1Afs, BARD1fs, BRCA2V1810I, fs, DCLRE1Cfs, FANCAfs, MSH3fs, PRKDCfs, SLX4fs, USP1fs, WRNfs, XRCC2fs | TP53Q331R, TP53BP1fs | PIK3CAQ546R, ATRfs, BRAFL597R, ERBB3R683Q |
| Prostate | VCaP | MSH3PPA66-68-, MSH6fs | TP53R248W | CCND1S219N, TMPRSS2-ERG, MYCamp |
| Prostate | LapC4 | ATM splice_donor, BRCA2fs, FANCD2splice_donor, MSH2splice_dono | TP53H178PX, R175H | ATRR1951*stop/amp, CDC7A342V/D571G, EGFRV980D |

TABLE 5-continued

Functional mutations of genes of tested cell lines

| Indication | Cell line | Functional Mutation | | |
|---|---|---|---|---|
| | | DDR/MMR deleterious | TP53/tumor suppressors | oncogenic replication stress |
| Prostate | DU-145 | ATG5splice_donor, FANCIfs, PRKDCfs, RB1K715*, TRRAPfs; UBE2Nfs, USP1fs, XPAfs, XRCC1splice_acceptor, XRCC2fs | TP53V274F; P223L, TP53BP1splice_acceptor | KRASamp, DYRK1R226H, TMPRSS2splice_acceptor |
| Prostate | PC3 | MSH3AAAAAAAAPP55-64A; PPA66-68-, PRKDCfs | TP53fs | MYCamp |
| Prostate | C4-2B | MSI-H, ARID1A_c.854delG_p.G285fs*78, MSH2loss, TRRAP-Q1984*, ATRX-E2265del | PTENdel | none |
| Breast | HCC70 | MSH3PPA66-68-, RB1DN479-480D | PTENfs, TP53R248Q | none |
| Breast | MDA-MB-436 | BRCA1splice_donor, PRKDCL1824F; fs | TP53fs | TMPRSS2V101F, MYCamp |
| Breast | MDA-MB-468 | FANCAQ869* | PTENsplice_donor, TP53R273H | ERBB2fs, ATRP? (2633 + 5A > G, Substitution – intronic) |
| Cervix | HeLa | REV3LQ2891* | none | EGFRI646L |
| Colon | LOVO | MSI-H, ARID1A-F2141fs*59, ATM-splice site 1236-2_1237delAGGC, CHEK2-T389fs*25, MSH2-G71del, NBNfs, BLMfs, POLQfs, PRKDCfs, RAD50fs, XRCC2-L117fs*17 | APCR1114* | KRASG13D |
| Colon | HT29 | FANCMfs, POLNR761*, POLQS1819*, PRKDCfs | APCE853*, fs, TP53R273H | MYCamp, BRAFV600E, T119S, PIK3CAP449T |
| Colon | Caco2 | none | APCQ1367* | ERBB3D857N |
| Colon | HCT-116 | ATMA1127V, ATRXTK1529-1530K, BRCA2fs, ERCC5splice_donor, FANCAfs, MLH1S252*, MSH3fs, MSH6fs, RAD50fs, REV3Lfs, SLX4A1461fs*2, USP1R180* | none | ERBB3Q261*, TOP2Afs, TOP2BR651H, KRASG13D, PIK3CA H1047R |
| Glioblastoma | U-87MG | none | PTENsplice_donor | ATRXN564S |
| Glioblastoma | M059J | PRKDCfs, TDP2R317* | PTENfs, TP53E286K | CCNE1R95L, ERBB2W452S |
| Lung | NCI-H1838 | ATMW1279*, MSH3AAAAAAAAPP55-64A; PPA66-68-, PRKDCfs | TP53R273L | ATRP1991S |
| Lung | NCI-H1703 | ATMG1998E, MSH3AAAAAAAAPP55-64A; PPA66-68-, PRKDCfs | TP53splice_donor, | none |
| Lung | NCI-H460 | MSH3AAAAAAAAPP55-64A, PRKDCfs | none | KRASQ61H, PIK3CAE545K, MYCamp |
| Lung | NCI-H2030 | MSH3AAAAAAAAPP55-64A; PPA66-68-, PRKDCfs | TP53G262V | KRASG12C |
| Lung | NCI-H23 | ATMQ1919P, MSH3E251*, PRKDCfs, SLX4ED1148-1149D | TP53M246I | CCNE1D83N, KRASG12C/amp, TOP2BH977Y, MYCamp, NRASamp |
| Lung | A549 | MSH3PPA66-68-, PRKDCfs | none | KRASG12S, ATRsplice, CCNEamp |
| Lymphoma, B cell | SU-DHL-8 | ATMK1964E, PRKDCfs, | TP53R249G; Y234N, | MYCp72S, Q10H, BRAFT599TT, CDC7K42N, TOP2AG1197E |

TABLE 5-continued

Functional mutations of genes of tested cell lines

| | | Functional Mutation | | |
|---|---|---|---|---|
| Indication | Cell line | DDR/MMR deleterious | TP53/tumor suppressors | oncogenic replication stress |
| Lymphoma, B cell | TMD-8 | none | none | MYCF3L |
| Lymphoma, mantle cell | REC-1 | PRKDCfs | TP53Q317*; G245D, | KRASamp |
| Lymphoma, mantle cell | Jeko-1 | MLH3I397-, PRKDCfs, RB1R621S | TP53fs | ATRT1751A, TMPRSS2Y82D |
| Lymphoma, mantle cell | GRANTA-519 | ATMR2832C | none | none |
| Lymphoma, mantle cell | JVM-2 | FANCMQ1701*, MSH3AAAAAAAAPP55-64A, PRKDCfs | none | none |
| Melanoma | HT-144 | ATMW2845*, PRKDCfs | none | BRAFV600E |
| Neuroblastoma | SH-SY5Y | CHEK2fs, MSH3PPA66-68-, PRKDCfs, | none | none |
| Ovarian | A2780 | ARID1AQ1430*, R1721fs*4, ATMP604S, FANCMfs, PRKDCfs, | PTEN K128_R130del | ATRI123V, ERBB3V1082I, TOP2BV530I, BRAFV226M, PIK3CAE365K |
| Ovarian | SK-OV-3 | ARID1AQ586*, ATMsplice_acceptor | APCfs, TP53fs | TOPBP1N295S, PIK3CAH1047R, KRASamp, CDC7del |
| Ovarian | IGROV-1 | MSI-H, ARID1AD1850fs*4, G276fs*87, ATMR248Q, BRCA1K654fs*47, CHEK1fs, MLH1S505fs*3, MSH6fs, POLQfs; POLNfs, RAD50fs | PTENfs, TP53Y126C | ERBB3K742, PIK3CAR38C; *1069W, TOP2AH605Q, TOPBP1D395G |
| Ovarian | OVCAR8 | ATMV613L | TP53splice_acceptor | ERBB2G776V, KRASP121H, MYCamp |
| Pancreas | BxPC3 | PRKDCfs | TP53Y220C | BRAFVTAPTP487-492A, |
| Pancreas | AsPc-1 | PRKDCfs | TP53fs | DYRK1AS14C, KRASG12D |
| Pancreas | MIAPaCa2 | none | TP53R248W | KRASG12C |

Abbreviations used in Tables 4 and 5: DDR: DNA damage repair; MMR: Mismatch repair; fs: frame shift; del: deletion; *: stop codon; amp: gene amplification; MSI-H: Microsatellite Instability High
IC50: compound concentration required to achieve 50% inhibition of the maximal cell growth.

TABLE 6

Inhibition of isogenic tumor cell line proliferation by Compound A

| Indication | Cell line | Defect | in vitro (IC50, nM) |
|---|---|---|---|
| Colorectal | DLD-1 parental | | 50 |
| Colorectal | DLD-1 BRCA2 (−/−) | BRCA2 deficiency (deleterious mutation of BRCA2) | 27 |
| Colorectal | DLD-1 ATM (−/−) | ATM deficiency (deleterious mutation of ATM) | 1.5 |

Abbreviations used in Table 6:
IC50: compound concentration required to achieve 50% inhibition of the maximal cell growth.

Example 2

In Vivo Xenotransplantation Models

The anti-tumor activity of Compound A was examined in murine xenotransplantation models of human cancer. For this purpose, mice were implanted subcutaneously with tumor cells. At a mean tumor size of 20-30 mm² animals were randomized into treatment and control groups (n=10 animals/group) and treatment started with vehicle only or Compound A (formulation: 60% PEG400/10% Ethanol/30% Water; application route: p.o./per os, orally; dose/schedule: 50 mg/kg twice daily for 3 days on/4 days off). The oral application volume was 10 ml/kg. The time interval between two applications per day was 6-7 h. The experiment was ended when the untreated control group had tumors of area ≤225 mm². The tumor size and the body weight were determined three times weekly. Changes in the body weight were a measure of treatment-related toxicity (>10%=critical, stop of treatment until recovery, >20%=toxic, termination). The tumor area was detected by means of an electronic caliper gauge [length (mm)×width (mm)]. In vivo anti-tumor efficacy is presented as T/C ratio (Treatment/Control) calculated with tumor areas at study end by the formula [(tumor area of treatment group at day x)−(tumor area of treatment group at day before first treatment)]/[(tumor area of control group at day x)−(tumor area of control group at day before first treatment)]. A compound having a T/C below 0.5 is defined as active (effective). Statistical analysis was assessed using SigmaStat software. A one-way analysis of variance was performed and differences to the control were compared by a pair-wise comparison procedure (Dunn's method).

Results (Table 7):

Compound A showed potent anti-tumor efficacy in different xenograft models of human tumors upon monotherapy treatment inducing stable disease in ovarian (A2780), prostate (PC3), colorectal cancer (LOVO) and complete tumor remission in mantle cell lymphoma (REC-1) at good tolerability.

TABLE 7

Anti-tumor activity of Compound A in different human cancer xenograft models in mice.

| Xenograft Model | T/C[a] | Max. weight loss[b] (%) |
|---|---|---|
| REC-1 | −0.13* | −10 |
| PC3 | −0.02* | −7 |
| LOVO | 0.13* | −8 |
| A2780 | 0.13* | −6 |

*P < 0.05 (compared to vehicle treated control)
[a]T/C = ratio of the tumor area of treatment versus [(tumor area of treatment group at day x) − (tumor area of treatment group at day before first treatment)]/[(tumor area of control group at day x) − (tumor area of control group at day before first treatment)].
[b]Loss of body weight: Changes in body weight compared to the initial body weight at the start of treatment (>10% = critical, stop of treatment until recovery, >20% = toxic, termination).
The abbreviation 2QD means twice per day, po means peroral Example 3

Treatment of Isogenic DT40 Chicken Lymphoma Cell Lines with Compound A

DT40 cells from isogenic cell lines (see Table 8) were seeded in 40 µl of growth medium (RPMI 1640 medium containing stabilized glutamine (#FG1215, Merck/Biochrom), supplemented with 10% fetal calf serum, 1% chicken serum, 100 U/ml penicillin, 100 µg/ml streptomycin, 5E-05M ß-mercaptoethanol) at 200 cells/well in 384-well white microtiter plates ((#6007680; Perkin Elmer Life Sciences) and incubated for 24 h at 37° C. Compound A was added using a digital dispenser (Tecan) to the cells in the test plates and incubated continuously for 3 days at 37° C. To determine cell viability (corresponding to cell number) 10 µl/well of CTG solution (Promega Cell Titer Glo solution, #G755B and G756B) was added. After incubation for further 10 min luminescence was measured using a PHERAstar FSX (BMG Labtech) equipment. All measurements were done in quadruplicates. The percentage change of cell viability was calculated by normalization with respect to the luminescence reading (cell number) at the beginning of treatment of cells (a reference plate was measured at the time point of compound application to the measurement plates) and the luminescence reading (cell number) of the untreated control group. Half-maximal growth inhibition ($IC_{50}$) was determined as compound concentration, which was required to achieve 50% inhibition of cellular growth using a 4-parameter fit.

To evaluate the relative cellular sensitivity of the isogenic DT40 cell lines towards Compound A the mean $IC_{50}$ of each mutant cell line was divided by the mean $IC_{50}$ of wild-type cells, and then the quotient was converted into logarithmic scale (base 2). $Log_2$ ratios of ≤−1 or ≥+1, corresponding to a 2-fold change in sensitivity relative to wild-type cells, were considered as particularly relevant.

Results

The activity of Compound A was tested in a panel of 46 isogenic cell lines derived from DT40 chicken lymphoma cells, which do not express TP53 (Takao et al., Oncogene 1999; 18: 7002-7009), covering inactivation of various genes involved in DNA damage signaling and DNA repair. Relative sensitivities against Compound A were calculated for the mutant cell lines versus the parental wild-type cell line (Table 9). The results indicate that cells deficient in the genes TP53BP1, RAD9A, RAD17, H2AFX, RAD52, BRCA1, BRCA2. UBE2N, PCNA, PARP1, TDP2, FANCD2, FANCG, POLL, POLL/POLB double mutated, REV3L, FEN1, XPA, ERCC5, or BLM are 2-fold or more than 2-fold more sensitive towards Compound A as compared to wild-type cells. Strong sensitizations (>4-fold) were observed with RAD17, PARP1, FANCD2, UBE2N, RAD9A, REV3L, TP53BP1, ERCC5, and BLM deficient DT40 cells, whereas the strongest effects (>8-fold) were detectable in PCNA, FEN1, H2AFX, BRCA1 deficient DT40 cells. These results demonstrate that deleterious mutations in the genes TP53BP1, RAD9A, RAD17, H2AFX, RAD52, BRCA1, BRCA2. UBE2N, PCNA, PARP1, TDP2, FANCD2, FANCG, POLL, POLL/POLB double mutated, REV3L, FEN1, XPA, ERCC5, or BLM sensitize tumor cells to treatment with Compound A.

TABLE 8

DT40 isogenic mutant cell lines. All cell lines were obtained from Kyoto University, Japan.

| Cell line | Gene | Function of deleted (mutated) gene(s), and annotation | Ref. |
|---|---|---|---|
| KU70 | XRCC6 | Non-homologous end joining | 1 |
| LIGASE IV | LIG4 | Non-homologous end joining | 2 |
| DNA-PKcs | PRKDC | Non-homologous end joining | 3 |
| RAP80 | UIMC1 | Functional interaction with Top2, Component of BRCA1-A complex, K63 poly-ubiquitin binding protein | 4 |
| 53BP1 | TP53BP1 | Inhibition of homologous recombination (Homologous recombination) | 5 |
| ATM | ATM | Damage check point control | 6 |
| RAD9 | RAD9A | Damage check point control | 7 |
| RAD17 | RAD17 | Damage check point control | 7 |
| H2AX | H2AFX | Homologous recombination | 8 |
| RAD52 | RAD52 | Homologous recombination, Rad51 like protein, Homologous recombination, single-strand DNA annealing | 9 |
| NBS1p70 | NBN | Homologous recombination | 10 |
| BRCA1 | BRCA1 | Homologous recombination | 11 |
| BRCA2 | BRCA2 | Homologous recombination | 12 |
| UBC13 | UBE2N | E2 ligase, post-replication repair | 13 |
| RAD18 | RAD18 | E3 ligase of PCNA, Post replication repair | 14 |
| PCNAK164R | PCNA | Post-replication repair | 15 |
| PARP1 | PARP1 | DNA damage sensing, poly(ADP-rybosyl)ation, SSB and DSB repair | 16 |
| TDP1 | TDP1 | Removal of Top1 cleavage complex (Top1cc) | 17 |
| TDP2 | TDP2 | Removal of Top2 cleavage complex (Top2cc) | 18 |

TABLE 8-continued

DT40 isogenic mutant cell lines. All cell lines were obtained from Kyoto University, Japan.

| Cell line | Gene | Function of deleted (mutated) gene(s), and annotation | Ref. |
|---|---|---|---|
| TDP1/TDP2 | TDP1/TDP2 | (See above) | 19 |
| FANCC | FANCC | Interstrand crosslink repair, Homologous recombination | 20 |
| FANCD2 | FANCD2 | Interstrand crosslink repair, Homologous recombination | 21 |
| FANCG | FANCG | Interstrand crosslink repair, Homologous recombination | 22 |
| USP1 | USP1 | Interstrand crosslink repair, Homologous recombination | 23 |
| UAF1 | WDR48 | Interstrand crosslink repair, Homologous recombination, USP1 association factor | 23 |
| SNM1A/1B | DCLRE1A/DCLRE 1B | Interstrand crosslink repair | 24 |
| ARTEMIS | DCLRE1C | 5'-3' exonuclease, non-homologous end joining | 24 |
| POLB | POLB | Base excision repair | 25 |
| POLL | POLL | DNA polymerase, Base excision repair | 25 |
| POLB/POLL | POLB/POLL | (See above) | 25 |
| POLN | POLN | Translesion synthesis DNA polymerase | 26 |
| POLQ | POLQ | Translesion synthesis DNA polymerase, Base excision repair, Helicase domain | 26 |
| POLN/POLQ | POLN-POLQ | (See above) | 26 |
| POLH | POLH | Translesion synthesis DNA polymerase | 27 |
| POLZ | REV3L | Translesion synthesis DNA polymerase | 28 |
| POLH/POLZ | POLH-REV3L | (See above) | 29 |
| FEN1 | FEN1 | 5' flap endonuclease, base excision repair, Homologous recombination | 30 |
| XPA | XPA | Nuclear excision repair | 31 |
| XPG | ERCC5 | Nuclear excision repair | 32 |
| FBH1 | FBXO18 | DNA helicase, Similar phenotype of BLM | 33 |
| BLM | BLM | RecQ helicase responsible for Bloom syndrome | 34 |
| WRN | WRN | RecQ helicase responsible for Werner syndrome | 35 |
| MSH3 | MSH3 | Mismatch repair | 36 |
| ATG5 | ATG5 | Autophagy related 5 homolog, autophagy, negative regulation of apoptosis | 37 |

TABLE 9

Inhibition of proliferation of isogenic DT40 cells by Compound A and relative sensitivities ($\log_2$ ratios).

| Cell line | Gene | $IC_{50}$ (M) | $\log_2$ (ratio) |
|---|---|---|---|
| Wild-type |  | 1.3E−07 | 0.00 |
| KU70 | XRCC6 | 1.2E−07 | −0.12 |
| LIGASE IV | LIG4 | 1.0E−07 | −0.38 |
| DNA-PKcs | PRKDC | 8.5E−08 | −0.61 |
| RAP80 | UIMC1 | 1.0E−07 | −0.38 |
| 53BP1 | TP53BP1 | 3.7E−08 | −1.81 |
| ATM | ATM | 1.1E−07 | −0.24 |
| RAD9 | RAD9A | 2.5E−08 | −2.38 |
| RAD17 | RAD17 | 2.1E−08 | −2.63 |
| H2AX | H2AFX | 1.2E−08 | −3.44 |
| RAD52 | RAD52 | 5.4E−08 | −1.27 |
| NBS1p70 | NBN | 1.2E−07 | −0.12 |
| BRCA1 | BRCA1 | 1.4E−08 | −3.22 |
| BRCA2 | BRCA2 | 4.7E−08 | −1.47 |
| UBC13 | UBE2N | 2.4E−08 | −2.44 |
| RAD18 | RAD18 | 6.7E−08 | −0.96 |
| PCNAK164R | PCNA | 8.5E−09 | −3.93 |
| PARP1 | PARP1 | 2.2E−08 | −2.56 |
| TDP1 | TDP1 | 9.9E−08 | −0.39 |
| TDP2 | TDP2 | 5.6E−08 | −1.22 |
| TDP1/TDP2 | TDP1/TDP2 | 6.6E−08 | −0.98 |
| FANCC | FANCC | 8.1E−08 | −0.68 |
| FANCD2 | FANCD2 | 2.3E−08 | −2.50 |
| FANCG | FANCG | 5.2E−08 | −1.32 |
| USP1 | USP1 | 1.3E−07 | 0.00 |
| UAF1 | WDR48 | 7.0E−08 | −0.89 |
| SNM1A/1B | DCLRE1A/DCLRE 1B | 9.9E−08 | −0.39 |
| ARTEMIS | DCLRE1C | 2.0E−07 | 0.62 |
| POLB | POLB | 1.3E−07 | 0.00 |
| POLL | POLL | 4.7E−08 | −1.47 |
| POLB/POLL | POLB/POLL | 5.6E−08 | −1.22 |
| POLN | POLN | 1.3E−07 | 0.00 |
| POLQ | POLQ | 7.4E−08 | −0.81 |
| POLN/POLQ | POLN-POLQ | 9.2E−08 | −0.50 |
| POLH | POLH | 7.7E−08 | −0.76 |
| POLZ | REV3L | 3.1E−08 | −2.07 |
| POLH/POLZ | POLH-REV3L | 1.2E−07 | −0.12 |
| FEN1 | FEN1 | 1.1E−08 | −3.56 |
| XPA | XPA | 4.6E−08 | −1.50 |
| XPG | ERCC5 | 4.1E−08 | −1.66 |
| FBH1 | FBXO18 | 1.5E−07 | 0.21 |
| BLM | BLM | 4.3E−08 | −1.60 |
| WRN | WRN | 7.1E−08 | −0.87 |
| MSH3 | MSH3 | 7.1E−08 | −0.87 |
| ATG5 | ATG5 | 1.5E−07 | 0.21 |

REFERENCES

1. Takata M, Sasaki M S, Sonoda E, Morrison C, Hashimoto M, Utsumi H, et al. Homologous recombination and non-homologous end-joining pathways of DNA doublestrand break repair have overlapping roles in the maintenance of chromosomal integrity in vertebrate cells. Embo J 1998; 17:5497-508.

2. Adachi N, Ishino T, Ishii Y, Takeda S, Koyama H. DNA ligase IV-deficient cells are more resistant to ionizing radiation in the absence of Ku70: Implications for DNA double-strand break repair. Proceedings of the National Academy of Sciences of the United States of America 2001; 98:12109-13.

3. Fukushima T, Takata M, Morrison C, Araki R, Fujimori A, Abe M, et al. Genetic analysis of the DNA-dependent protein kinase reveals an inhibitory role of Ku in late SG2 phase DNA double-strand break repair. J Biol Chem 2001; 276:44413-8.

4. Iijima J, Zeng Z, Takeda S, Taniguchi Y. RAP80 Acts Independently of BRCA1 in Repair of Topoisomerase II Poison-Induced DNA Damage Cancer Res. 2010; 70:8467-8474
5. Nakamura K, Sakai W, Kawamoto T, Bree R T, Lowndes N F, Takeda S, et al. Genetic dissection of vertebrate 53BP1: a major role in non-homologous end joining of DNA double strand breaks. DNA Repair (Amst) 2006; 5:741-9.
6. Takao N, Kato H, Mori R, Morrison C, Sonada E, Sun X, et al. Disruption of ATM in p53-null cells causes multiple functional abnormalities in cellular response to ionizing radiation. Oncogene 1999; 18:7002-9.
7. Kobayashi M, Hirano A, Kumano T, Xiang S L, Mihara K, Haseda Y, Matsui O, Shimizu H, Yamamoto K. Critical role for chicken Rad17 and Rad9 in the cellular response to DNA damage and stalled DNA replication. Genes Cells 2004; 9:291-303
8. Sonoda E, Zhao G Y, Kohzaki M, Dhar P K, Kikuchi K, Redon C, et al. Collaborative roles of gammaH2AX and the Rad51 paralog Xrcc3 in homologous recombinational repair. DNA Repair (Amst) 2007; 6:280-92.
9. Yamaguchi-Iwai Y, Sonoda E, Buerstedde J M, Bezzubova O, Morrison C, Takata M, et al. Homologous recombination, but not DNA repair, is reduced in vertebrate cells deficient in RAD52. Mol Cell Biol 1998; 18:6430-5.
10. Nakahara M, Sonoda E, Nojima K, Sale J E, Takenaka K, Kikuchi K, et al. Genetic evidence for single-strand lesions initiating Nbs1-dependent homologous recombination in diversification of Ig v in chicken B lymphocytes. PLoS genetics 2009; 5:e1000356.
11. Martin R W, Orelli B J, Yamazoe M, Minn A J, Takeda S, Bishop D K. RAD51 upregulation bypasses BRCA1 function and is a common feature of BRCA1-deficient breast tumors. Cancer Res 2007; 67:9658-65.
12. Hatanaka A, Yamazoe M, Sale J E, Takata M, Yamamoto K, Kitao H, et al. Similar effects of Brca2 truncation and Rad51 paralog deficiency on immunoglobulin V gene diversification in DT40 cells support an early role for Rad51 paralogs in homologous recombination. Molecular and cellular biology 2005; 25:1124-34.
13. Zhao G Y, Sonoda E, Barber L J, Oka H, Murakawa Y, Yamada K et al. A critical role for the ubiquitin-conjugating enzyme Ubc13 in initiating homologous recombination. Mol Cell. 2007; 25:663-75.
14. Yamashita Y M, Okada T, Matsusaka T, Sonoda E, Zhao G Y, Araki K, et al. RAD18 and RAD54 cooperatively contribute to maintenance of genomic stability in vertebrate cells. Embo J 2002; 21:5558-66.
15. Arakawa H, Moldovan G L, Saribasak H, Saribasak N N, Jentsch S, Buerstedde J M. A role for PCNA ubiquitination in immunoglobulin hypermutation. PLoS biology 2006; 4:e366.
16. Hochegger H, Dejsuphong D, Fukushima T, Morrison C, Sonoda E, Schreiber V, et al. Parp-1 protects homologous recombination from interference by Ku and Ligase IV in vertebrate cells. Embo J. 2006; 25:1305-14.
17. Murai J, Huang S Y, Das B B, Dexheimer T S, Takeda S, Pommier Y. Tyrosyl-DNA phosphodiesterase 1 (TDP1) repairs DNA damage induced by topoisomerases I and II and base alkylation in vertebrate cells. J Biol Chem 2012; 287:12848-57.
18. Zeng Z, Cortes-Ledesma F, El Khamisy S F, Caldecott K W. TDP2/TTRAP is the major 5'-tyrosyl DNA phosphodiesterase activity in vertebrate cells and is critical for cellular resistance to topoisomerase II-induced DNA damage. J Biol Chem 2011; 286:403-9.
19. Zeng Z, Sharma A, Ju L, Murai J, Umans L, Vermeire L, et al. TDP2 promotes repair of topoisomerase I-mediated DNA damage in the absence of TDP1. Nucleic Acids Res 2012.
20. Hirano S, Yamamoto K, Ishiai M, Yamazoe M, Seki M, Matsushita N, et al. Functional relationships of FANCC to homologous recombination, translesion synthesis, and BLM. Embo J 2005; 24:418-27.
21. Yamamoto K, Hirano S, Ishiai M, Morishima K, Kitao H, Namikoshi K, et al. Fanconi anemia protein FANCD2 promotes immunoglobulin gene conversion and DNA repair through a mechanism related to homologous recombination. Molecular and cellular biology 2005; 25:34-43.
22. Yamamoto K, Ishiai M, Matsushita N, Arakawa H, Lamerdin J E, Buerstedde J M, et al. Fanconi anemia FANCG protein in mitigating radiation- and enzyme-induced DNA double-strand breaks by homologous recombination in vertebrate cells. Molecular and cellular biology 2003; 23:5421-30.
23. Murai J, Yang K, Dejsuphong D, Hirota K, Takeda S, D'Andrea A D. The USP1/UAF1 Complex Promotes Double-Strand Break Repair through Homologous Recombination. Mol Cell Biol 2011; 31:2462-9.
24. Ishiai M, Kimura M, Namikoshi K, Yamazoe M, Yamamoto K, Arakawa H, et al. DNA cross-link repair protein SNM1A interacts with PIAS1 in nuclear focus formation. Molecular and cellular biology 2004; 24:10733-41.
25. Tano K, Nakamura J, Asagoshi K, Arakawa H, Sonoda E, Braithwaite E K, et al. Interplay between DNA polymerases beta and lambda in repair of oxidation DNA damage in chicken DT40 cells. DNA Repair (Amst) 2007; 6:869-75.
26. Yoshimura M, Kohzaki M, Nakamura J, Asagoshi K, Sonoda E, Hou E, et al. Vertebrate POLQ and POL beta cooperate in base excision repair of oxidative DNA damage. Molecular cell 2006; 24:115-25.
27. Kawamoto T, Araki K, Sonoda E, Yamashita Y M, Harada K, Kikuchi K, et al. Dual roles for DNA polymerase eta in homologous DNA recombination and translesion DNA synthesis. Molecular cell 2005; 20:793-9.
28. Sonoda E, Okada T, Zhao G Y, Tateishi S, Araki K, Yamaizumi M, et al. Multiple roles of Rev3, the catalytic subunit of polzeta in maintaining genome stability in vertebrates. Embo J 2003; 22:3188-97.
29. Hirota K, Sonoda E, Kawamoto T, Motegi A, Masutani C, Hanaoka F, et al. Simultaneous disruption of two DNA polymerases, Poleta and Polzeta, in Avian DT40 cells unmasks the role of Poleta in cellular response to various DNA lesions. PLoS genetics 2010; 6.
30. Matsuzaki Y, Adachi N, Koyama H. Vertebrate cells lacking FEN-1 endonuclease are viable but hypersensitive to methylating agents and H2O2. Nucleic Acids Res 2002; 30:3273-7.
31. Okada T, Sonoda E, Yamashita Y M, Koyoshi S, Tateishi S, Yamaizumi M, et al. Involvement of vertebrate polkappa in Rad18-independent postreplication repair of UV damage. J Biol Chem 2002; 277:48690-5.
32. Kikuchi K, Taniguchi Y, Hatanaka A, Sonoda E, Hochegger H, Adachi N, et al. Fen-1 facilitates homologous recombination by removing divergent sequences at DNA break ends. Molecular and cellular biology 2005; 25:6948-55.
33. Kohzaki M, Hatanaka A, Sonoda E, Yamazoe M, Kikuchi K, Vu Trung N, et al. Cooperative roles of vertebrate Fbh1 and Blm DNA helicases in avoidance of crossovers during recombination initiated by replication fork collapse. Mol Cell Biol 2007; 27:2812-20.
34. Imamura O, Fujita K, Shimamoto A, Tanabe H, Takeda S, Furuichi Y, et al. Bloom helicase is involved in DNA surveillance in early S phase in vertebrate cells. Oncogene 2001; 20:1143-51.
35. Imamura O, Fujita K, Itoh C, Takeda S, Furuichi Y, Matsumoto T. Werner and Bloom helicases are involved in DNA repair in a complementary fashion. Oncogene 2002; 21:954-63.
36. Nojima K, Hochegger H, Saberi A, Fukushima T, Kikuchi K, Yoshimura M, Orelli B J, Bishop D K, Hirano S, Ohzeki M, Ishiai M, Yamamoto K, Takata M, Arakawa H, Buerstedde J M, Yamazoe M, Kawamoto T, Araki K, Takahashi J A, Hashimoto N, Takeda S, Sonoda E. Multiple repair pathways mediate tolerance to chemotherapeutic cross-linking agents in vertebrate cells. Cancer Res. 2005; 65:11704-11711.
37. Maede Y, Shimizu H, Fukushima T, Kogame T et al. Differential and common DNA repair pathways for topoisomerase I- and II-targeted drugs in a genetic DT40 repair cell screen panel. Mol Cancer Ther 2013; 13; 214-20.

SEQUENCE LISTING (222 sequences)

SEQ ID NO: 1 - DNA, 11025 bp, Homo sapiens
  >APC|ENSG00000134982|ENST00000457016|11025
acaagatggcggagggcaagtagcaagggggcggggtgtggccgccggaagcctagccgctgctcgggggggacctgcgggctcaggcccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgca

SEQ ID NO: 2 - DNA, 8577 bp, Homo sapiens
  >ARID1A|ENSG00000117713|ENST00000324856|8577
gaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaa

SEQ ID NO: 3 - DNA, 3216 bp, Homo sapiens
  >ATG5|ENSG00000057663|ENST00000369076|3216
ctggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaa

SEQ ID NO: 4 - DNA, 13147 bp, Homo sapiens
  >ATM|ENSG00000149311|ENST00000278616|13147
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagaatacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 5 - DNA, 8249 bp, Homo sapiens
  >ATR|ENSG00000175054|ENST00000350721|8249
ttccgggaggagttttggcctccacacggctccgtcgggcgccgcgctcttccggcagcggtagctttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 6 - DNA, 11167 bp, Homo sapiens
  ATRX|ENSG00000085224|ENST00000373344|11167
ctcggcccaacaaaatggcggcggcagcggtgtcgctttgtttccgcggctcctgcggcggtggcagtggtagcggcctttgagctgtggggaggttccagcagcagctacagtgacgactaagactccagtgcatttctatcgtaaccgggcgcgggggagcgcagatcggcgcccagcaatcacagaagccgacaaggcgttcaagcgaaaacatgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtgatagaaattgaagatgcttcacccaccaagtgtccaataacaaccaagttggttttagatgaagatgaagaaaccaaagaacctttagtgcaggttcatagaaatatggttatcaaattgaaaccccatcaagtagatggtgttcagtttatgtgggattgctgctgtgagtctgtgaaaaaaacaaagaaatctccaggttcaggatgcattcttgcccactgtatgggccttggtaagactttacaggtggtaagttttcttcatacagttcttttgtgtgacaaactggatttcagcacggcgttagtggtttgtcctcttaatactgctttgaattggatgaatgaatttgagaagtggcaagagggattaaaagatgatgagaagcttgaggtttctgaattagcaactgtgaaacgtcctcaggagagaagctacatgctgcagaggtggcaagaagatggtggtgttatgatcataggctatgagatgtatagaaatcttgctcaaggaaggaatgtgaagagtcggaaacttaaagaaatatttaacaaagctttggttgatccaggccctgattttgttgtttgtgatgaaggccatattctaaaaaatgaagcatctgctgtttctaaagctatgaattctatacgatcaaggaggaggattattttaacaggaacaccacttcaaaataacctaattgagtatcattgtatggttaattttatcaaggaaaatttacttggatccattaaggagttcaggaatagatttataaatccaattcaaaatggtcagtgtgcagattctaccatggtagatgtcagagtgatgaaaaaacgtgctcacattctctatgagatgttagctggatgtgttcagaggaaagattatacagcattaacaaaattcttgcctccaaaacacgaatatgtgttagctgtgagaatgacttctattcagtgcaagctctatcagtactacttagatcacttaacaggtgtgggcaataatagtgaaggtggaagaggaaaggcaggtgcaaagcttttccaagattttcagatgttaagtagaatatggactcatccttggtgtttgcagctagactacattagcaaagaaaataagggttattttgatgaagacagtatggatgaatttatagcctcagattctgatgaaacctccatgagtttaagctccgatgattatacaaaaaagaagaaaaaagggaaaaaggggaaaaaagatagtagctcaagtggaagtggcagtgacaatgatgttgaagtgattaaggtctggaattcaagatctcggggaggtggtgaaggaaatgtggatgaaacaggaaacaatccttctgtttctttaaaactggaagaaagtaaagctacttcttcttctaatccaagcagcccagctccagactggtacaaagattttgttacagatgctgatgctgaggttttagagcattctgggaaaatggtacttctctttgaaattcttcgaatggcagaggaaattggggataaagtccttgttttcagccagtccctcatatctctggacttgattgaagattttcttgaattagctagtagggagaagacagaagataaagataaaccccttatttataaaggtgaggggaagtggcttcgaaacattgactattaccgtttagatggttccactactgcacagtcaaggaagaagtgggctgaagaatttaatgatgaaactaatgtgagaggacgattatttatcatttctactaaagcaggatctctaggaattaatctggtagctgctaatcgagtaattatattcgacgcttcttggaatccatcttatgacatccagagtatattcagagtttatcgctttggacaaactaagcctgtttatgtatataggttcttagctcagggaaccatggaagataagatttatgatcggcaagtaactaagcagtcactgtcttttcgagttgttgatcagcagcaggtggagcgtcattttactatgaatgagcttactgaactttatacttttgagccagacttattagatgaccctaattcagaaaagaagaagaagagggatactcccatgctgccaaaggataccatacttgcagagctccttcagatacataaagaacacattgtaggataccatgaacatgattctcttttggaccacaaagaagaagaagagttgactgaagaagaaagaaaagcagcttgggctgagtatgaagcagagaagaagggactgaccatgcgtttcaacataccaactgggaccaatttaccccctgtcagtttcaactctcaaactccttatattcctttcaatttgggagccctgtcagcaatgagtaatcaacagctggaggacctcattaatcaaggaagagaaaaagttgtagaagcaacaaacagtgtgacagcagtgaggattcaacctcttgaggatataatttcagctgtatggaaggagaacatgaatctctcagaggcccaagtacaggcgttagcattaagtagacaagccagccaggagcttgatgttaaacgaagagaagcaatctacaatgatgtattgacaaaacaacagatgttaatcagctgtgttcagcgaatacttatgaacagaaggctccagcagcagtacaatcagcagcaacagcaacaaatgacttatcaacaagcaacactgggtcacctcatgatgccaaagcccccaaatttgatcatgaatccttctaactaccagcagattgatatgagaggaatgtatcagccagtggctggtggtatgcagccaccaccattacagcgtgcaccacccccaatgagaagcaaaaatccaggaccttcccaagggaaatcaatgtgattttgcactaaaagcttaatggattgttaaaatcatagaaagatcttttatttttttaggaatcaatgacttaacagaactcaactgtataaatagtttggtccccttaaatgccaatcttccatattagttttactttttttttttttaaatagggcataccatttcttcctgacatttgtcagtgatgttgcctagaatcttcttacacacgctgagtacagaagatatttcaaattgttttcagtgaaaacaagtccttccataatagtaacaactccacagatttcctctctaaatttttatgcctgcttttagcaaccataaaattgtcataaaattaataaatttaggaaagaataaagatttatatattcattctttacatataaaaacacacagctgagttcttagagttgattcctcaagttatgaaatacttttgtacttaatccatttcttgattaaagtgattgaaatggttttaatgttcttttgactgaagtctgaaactgggctcctgctttattgtctctgtgactgaaagttagaaactgagggttatctttgacacagaattgtgtgcaatattcttaaatactactgctctaaaagttggagaagtcttgcagttatcttagcattgtataaacagccttaagtatagcctaagaagagaattcctttttcttctttagtccttctgccattttttattttcagttatatgtgctgaaataattactggtaaaatttcagggttgtggattatcttccacacatgaattttctctctcctggcacgaatataaagcacatctcttaactgcatggtgccagtgctaatgcttcatcctgttgctggcagtgggatgtggacttagaaaatcaagttctagcattttagtaggttaacactgaagttgtggttgttaggttcacaccctgttttataaacaacatcaaaatggcagaaccattgctgactttaggttcacatgaggaatgtacttttaacaattcccagtactatcagtattgtgaaataattcctctgaaagataagaatcactggcttctatgcgcttcttttctctcatcatcatgttcttttaccccagtttccttacatttttttaaattgtttcagagtttgttttttttttagtttagattgtgaggcaattattaaatcaaaattaattcatccaatacccctttactagaagttttactagaaaatgtattacattttattttttcttaatccagttctgcaaaaatgacctataaatttattcatgtacaattttggttacttgaattgttaaagaaaacattgtttttgactatgggagtcaactcaacatggcagaaccatttttgagatgatgatacaacaggtagtgaaacagcttaagaattccaaaaaaaaaaaaaaaaaaaaaaaaaagaaaactgggtttgggctttgctttaggtatcactggattagaatgagtttaacattagctaaaactgctttgagttgtttggatgattaagagattgccatttttatcttggaagaactagtggtaaaacatccaagagcactaggattgtgatacagaatttgtgaggtttggtggatccacgcccctctcccccactttcccatgatgaaatatcactaataaatcctgtatatttagatattatgctagccatgtaatcagatttatttaattgggtggggcaggtgtgtatttactttagaaaaaatgaaaaagacaagatttatgagaaatatttgaaggcagtacactctggccaactgttaccagttggtatttctacaagttcagaatattttaaacctgatttactagacctgggaattttcaacatggtctaattatttactcaaagacatagatgtgaaaattttaggcaaccttctaaatctttttcaccatggatgaaactataacttaaagaataatacttagaagggttaattggaaatcagagtttgaaataaaacttggaccactttgtatacactcttctcacttgacattttagctatataatatgtactttgagtataacatcaagctttaacaaatatttaaagacaaaaaaatcacgtcagtaaaatactaaaaggctcatttttatatttgttttagatgttttaaatagttgcaatggattaaaaatgatgatttaaaatgttgcttgtaatacagttttgcctgctaaattctccacattttgtaacctgttttatttctttgggtgtaaagcgtttttgcttagtattgtgatattgtatatgttttgtcccagttgtatagtaatgtttcagtccatcatccagctttggctgctgaaatcatacagctgtgaagacttgcctttgtttctgttagactgcttttcagttctgtattgagtatcttaagtactgtagaaaagatgtcacttcttcctttaaggctgttttgtaatatatataaggactggaattgtgtttttaaagaaaagcattcaagtatgacaatatactatctgtgttttcaccattcaaagtgctgtttagtagttgaaacttaaactatttaatgtcatttaataaagtgaccaaaatgtgttgtgctctttattgtattttcacagctttgaaaatctgtgcacatactgtttcatagaaaatgtatagcttttgttgtcctatataatggtggttcttttgcacatttagttatttaatattgagaggtcacgaagtttggttattgaatctgttatatactaaattctgtaaagggagatctctcatctcaaaaagaatttacataccaggaagtccatgtgtgtttgtgttagttttggatgtctttgtgtaatccagccccatttcctgtttcccaacagctgtaacactcattttaagtcaagcagggctaccaacccacacttgatagaaaagctgcttaccattcagaagcttccttattacctggcctccaaatgagctgaatattttgtagccttcccttagctatgttcattttccctccattatcataaaatcagatcgatatttatgtgccccaaacaaaactttaagagcagttacattctgtcccagtagcccttgtttcctttgagagtagcatgttgtgaggctatagagacttattctaccagtaaaacaggtcaatccttttacatgtttattatactaaaaattatgttcagggtatttactactttatttcaccagactcagtctcaagtgacttggctatctccaaatcagatctacccttagagaataaacatttttctaccgttattttttttcaagtctataatctgagccagtcccaaaggagtgatcaagtttcagaaatgctttcatcttcacaacattttatatatactattatatggggtgaataaagttttaaatccgaaatata

SEQ ID NO: 7 - DNA, 2590 bp, Homo sapiens
  >ATRIP|ENSG00000164053|ENST00000320211|2590
gggcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 8 - DNA, 3937 bp, Homo sapiens
  >BAP1|ENSG00000163930|ENST00000460680|3937
cgctccgcccctcccctcgcagcacccgggcctagtactgcccgtcccgcccctcctctcgagcctcagcgctcagcatcgcccggaccccctcttcccttcgcccgcctcgtcccgaccctccccttcgcccccgtcccgccccgcccctccccttcgcccccgtcccgtcccgccccgcccctccccttcgcccccgtccctccccttcgcccccgtccctccgcgcgtgcgcgttcgccttcgagcgcatgcccgcatctgctgtccgacaggcggaagacgagcccagaggcggagcagggccgtcgcgccttggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctg

SEQ ID NO: 9 - DNA, 5499 bp, Homo sapiens
  >BARD1|ENSG00000138376|ENST00000260947|5499
cctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccacctttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatgcattaatcatattctaaacgttcatgggcctcattacagtcacaattgtctattctgtttcctaccctgaacacattaaaatggtaggaactaatgcttgtcttatttaattactaaaagccaccattttctttgatagattgagctacagattgtaaacttcatgtatttctttataagtcaacccttttcaaagatacgcacatcaaactgaatgaataaataaatattgagaagttg

SEQ ID NO: 10 - DNA, 4555 bp, Homo sapiens
  >BLM|ENSG00000197299|ENST00000355112|4555
aatcggaataggcaagcttccggcgggaagtgagccagggcttggcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagca

SEQ ID NO: 11 - DNA, 2480 bp, Homo sapiens
  >BRAF|ENSG00000157764|ENST00000288602|2480
cgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtgaaccaaagaa

SEQ ID NO: 12 - DNA, 5936 bp, Homo sapiens
  >BRCA1|ENSG00000012048|ENST00000471181|5936
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagattcgcatatacatggccaaaggaacaactccatgttttctaaaaggcctagagaacatatatcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagctta

SEQ ID NO: 13 - DNA, 10984 bp, Homo sapiens
  >BRCA2|ENSG00000139618|ENST00000544455|10984
gtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaatcaacaaaatggtcatccaaactcaaacttgagaaaatatcttgctttcaaattggcact

SEQ ID NO: 14 - DNA, 6048 bp, Homo sapiens
  >BRIP1|ENSG00000136492|ENST00000259008|6048
aattcgtctcgggttgtgtggttgaggggtctggtgggtcgaggaaaggtaacggcggccccagtcctgcacacaaggccggggaagtagcagcacccccaggaagagggaggaggaagggctcgtgccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagactcccctgaaaaaaccactctggctgcaaagttatctgctaagaaacaggcatccatatacagagatgaaaatgatgattttcaagtagagaagaaaagaattcgacccttagaaactacacagcagattagaaaacgtcattgctttggaacagaagtacacaatttggatgcaaaagttgattcaggaaagactgtaaaactcaactctccactggaaaagataaactccttttcgccacagaaaccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtagatgtattagacacagaaatgattggggagctcttattctagtggatgatcgctttaggaataacccaagtcgctatatatctggactttctaaatgggtacggcagcagattcagcaccattcaacctttgaaagtgcactggaatccttggctgaattttccaaaaagcatcaaaaagttcttaatgtatccataaaggacagaaccaatatacaggacaatgagtctacacttgaagtgacctctttaaagtacagtacctcaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaaatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttatgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttttttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtgagccacagtgcctggcccattcttgagttttgataaagtaattcatacaaagtactgtcctcaaataagtcttccttagctaaatgcaatttaaaattattcaaagatcctagggcacttctagtttcacgtaaatattcatattaggtggttctcttcatccatttgttttcacactgatacataaaaattaacagcagtctaatctagtgacacctcagtcatatttcgctatagattttacctcaaatcagtccaagactttttcagagatcaccatttgtcttgaaaggtttatttcgttattaaactgcctacttataagtaattaagagaaattaagaaagtagtatgcatttttaattgaaattgttttacattctttgtataataaacctaaaaccaaacatgtcataaacaaattgacgtaaagatataaaatgccaaatgaagtattccaaattttctattctaattatttagcttcaccatcattgtggaaaaaaatactagatcctgcttagtattatatatttttcctagtggatcagtgagtaataagtaccaaacactagactagaaggtaatttctacattgtttagaaagggtgaaacaatttatcccctctggtattgttctagcataagctttagttatacaatgattaagatagaaaacttcatatataaatttgataagcaaacccacatttatagctgcagctaaaatatgtttccttagggcacagtaatcctttctgtgaattttgaccttgtttgtgtttttgtgaatgaagctatatgtctaatcaaaaatgattataaaagaggctcatctctgacatcattccaaaaatacattcattgatctctttttaagaaacatctgttattcactgggcattgggactttttgtgagtaatttgaattgaaattttatgagctatccaagaattctgtatggtctattattttcaagtcaaaatttccagtaaggatttactttacatttcatttggataaatgaatcattatataggtatgtctttgcttccattttgagacatttagatttttacagcctgtttctatagcatttgatgttacaactctaagcgtagttcaaagacatttaaattgacaagttaccagttaaagaatttagaatatattagatcccatctagtattatatattttttctagttgatcattgagcagtaaataccaaatactcgattagaaggtaatttttacattgttttgaaagggtgaaacaatttatctcctctggtattattcttaaaccacagatagggatagtagggtagtgaaacgaataaatacctggtagaagacaagagacttgggctctacacctggctctgccactgatttgctaagtcatattggcaatcaccacacccttcagggaattagtttcatctgtaaaatgcagcggttagtactataaaatcatacaaatttctttgtgctttgagaatctataaaggaatgtctgttgatattctgagtcgattttcatttgcttttgttccagaacggttaaaataaagcatattatttcatttaaaaagtaaa

SEQ ID NO: 15 - DNA, 4307 bp, Homo sapiens
  >CCND1|ENSG00000110092|ENST00000227507|4307
gcttaacaacagtaacgtcacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 16 - DNA, 2043 bp, Homo sapiens
  >CCNE1|ENSG00000105173|ENST00000262643|2043
gaggggctgggagccgcggcggggcggtgcgagggcgggccggggccggttccgcgcgcagggattttaaatgtcccgctctgagccgggcgcaggagcagccggcgcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttga

SEQ ID NO: 17 - DNA, 3330 bp, Homo sapiens
  >CCNE2|ENSG00000175305|ENST00000520509|3330
ccgcgaggctccgtctccccggcgcggcccgctcgccgtccggctcgctcagggcctgggcagacgcggcccgcccgagctaccgcgggttccgagacgccttcgcactgctcctccacccgggggatctttgttcccggagctgttccccgcctcgctgctcccgccgcaaaacctgtttgcggaatacccgccgcaagtctgacttgacgatgtgcagttttgggaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagtaaagttttgccattgcttggagaaacttttttttccttctctgcgctgccagctgtaacacttcttctggattgcttgcattcaactctgtctggccgatggctttgatcttccaaaacagaaaagtgatgttattagaggtgtgtcaaaaattaagttttgttggtacaagtaatataaagctacctacgtgctaacaacgatacagtttaatgattaactgaacctcttaactgtaaaacccaggagtcttggaaaaaaattaacataaagattaaccagggccactctcaaggaaagatggactgctgagccatagtttatggaattacttaagtggcattttaatatattaagtaaattcatgtaaatttatttgaaagtataagtaagctctacatggcgatttttagagttaaactagggctccacttgttaatgtgcaaaaataactggt

SEQ ID NO: 18 - DNA, 3313 bp, Homo sapiens
  >CDC7|ENSG00000097046|ENST00000428239|3313
atctggttcggtctctggcccgagggaagccggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaatttgaatgctcttgaatttgtatattcaataaagttatccttttatatttttta

SEQ ID NO: 19 - DNA, 8336 bp, Homo sapiens
  >CDK12|ENSG00000167258|ENST00000447079|8336
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccaaggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcagcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtgggggattgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctctctctctctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcattgtattttggttatcagcagtcatcaataatgtttttccctcccctctcccacctcttatttttaattatgccaaatatcctaaataatatacttaagcctccattccctcatccctactagggaagggggtgagtgtatgtgtgagtgtatgtgtatgtatgatcccatctcacccccacccccattttgggagtcttttaaaatgaaaacaaagtttggtagttttgactatttctaaaagcagaggagaaaaaaaaacttatttaaatatcctggaatctgtatggaggaagaaaaggtatttgttaatttttcagttacgttatctataaacatgatggaagtaaaggtttggcagaatttcaccttgactatttgaaaattacagacccaattaattccattcaaaagtggttttcgttttgttttaattattgtacaatgagagatattgtctattaaatacattattttgaacagatgagaaatctgattctgttcatgagtgggaggcaaaactggtttgaccgtgatcatttttgtggttttgaaaacaaatatacttgacccagtttccttagttttttcttcaactgtccataggaacgataagtatttgaaagcaacatcaaatctatacgtttaaagcagggcagttagcacaaatttgcaagtagaacttctattagcttatgccatagacatcacccaaccacttgtatgtgtgtgtgtatatataatatgcatatatagttaccgtgctaaaatggttaccagcaggttttgagagagaatgctgcatcagaaaagtgtcagttgccacctcattctccctgatttaggttcctgacactgattcctttctctctcgtttttgacccccattgggtgtatcttgtctatgtacagatattttgtaatatattaaatttttttctttcagtttataaaaatggaaagtggagattggaaaattaaatatttcctgttactataccacttttgctccattgcatttacttcttaatctgtaccccctgagcatatctaatcatgtataaaggacgtttttcctccactttatcttaggggttctctgtctcagaatcattatagactcattaactccccctcccagcaaaaggttatcaggatttgaagaggtgcttgaaaacgctagactaggaactagagaataaatgagttgggaaaaaccatgaaatgtgatttttttaaagtagaaaagttatacaaataatggtaccaaaccatcaaaagagttgagcttcatgtaccctgactcctcctgacaggagaggtaagtgggtttgagctcaactgtcatcaagggaagttggtaagaggctgtttagacccaaaggatagtcttaaaccagacttcaccacccaccctacctcagttcccatgttattacatgcagagtcagcatggggattagtgtacctacctttgctgagatttcccgatgcgttgccaatccagaaagtgaatcaaaaagttgtttaaaagttaaaatctctattgtttccaaaatctttcccatctccacctgaagacagaattgcttccccttctc

SEQ ID NO: 20 - DNA, 3502 bp, Homo sapiens
  >CHEK1|ENSG00000149554|ENST00000534070|3502
gcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatt

SEQ ID NO: 21 - DNA, 1971 bp, Homo sapiens
  >CHEK2|ENSG00000183765|ENST00000382580|1971
atctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgagacagagtctggccatgttacccaatctgatcttgaactcctgctgtcatctgatcctcctgcctcagcctcccaaagtgctgggataagaggtgtgaggcaccatccccggccagtttgcagtctaaaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaatt

SEQ ID NO: 22 - DNA, 4464 bp, Homo sapiens
  >DCLRE1A|ENSG00000198924|ENST00000361384|4464
ggactctgagggctttttggagctcgctatgcttaacctggagatgattaaggccccgcttcctggcctcccagcctctaatgccaaaagataagggagaggctggcgtgtgaccccgttttgagtcaggtggacagagggctggccaccttcggaaccatgggtgcaatacggagtcagacctcaatacaagcccactctttcacatatttgaacttttttcacatatcaactttttttgttcactgtgcagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaaaaagagccgcagaagctaaagaggtgaaggaccatgaagtgccccttggaaatgcaggttgtcagacttctgttgcttctagtcagaattcaagttgtggagatggtattcagcagacccaagacaaggaaactactccaggaaaactctgtagaactcaaaaaagccaacacgtgtccccaaagatacgtccagtttatgatggatactgtccaaattgccagatgcctttttcctcattgatagggcagacacctcgatggcatgtttttgaatgtttggattctccaccacgctctgaaacagagtgtcctgatggtcttctgtgtacctcaaccattccttttcattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttaaaaagtctccgtctctgactgaagccagtgaaaagatttctactcatatccaaacatcccaacaagctctacaatttacagattttgttgagaatgacaaactagtgggagttgctttgcgtcttgcaaacaactcagaacacataaatttgccattgccagaaaatgacttcagtgactgtgaaatctcctattctccacttcaaagtgatgaagacactcatgatatcgatgaaaaaccggatgattcacaagaacaactgttttttaccgaaagctcaaaagatggcagcctcgaagaagatgatgacagctgtggtttttttaaaaaacgacatggtcccttactgaaggaccaggatgagagctgccccaaagtgaacagcttcttaactcgggataagtatgatgaaggattgtatagattcaatagtctaaatgatttgtctcaacctatttctcaaaataatgagagtactttgccttatgatctggcatgtactggtggtgattttgtgttgtttccacctgcattggcagggaagcttgctgcttctgttcatcaggcaactaaagcaaaacctgatgagccagaatttcactcagctcaatcaaataaacagaaacaggtaattgaagaatcatctgtttacaatcaagtttctcttccgttagttaagagtttaatgttgaaaccttttgaaagtcaggtagaagggtatctttcttcccaaccaacccaaaatacaattagaaaattatcaagtgagaacttgaatgctaagaataatactaactcagcatgtttctgcagaaaggcattagagggtgtgccagttggtaaagctacaattttaaatacagaaaacttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataaacttaaatccagttccaagtcctaatcaaaagaggtcctcgcagtgcaagaggaaagcagaaaaatctttaagtgatttagaatttgatgcaagtactttacatgagagtcagctttctgtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggaaccggctttacagttgatgcctttcagtatggcgtggttgaaggttgcacagcctattttctcacacattttcattctgatcattatgctggattgtctaaacacttcacatttccagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctaatggtactgtcatattacacacgggagacttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttctcccaatgatgcaaattaattttaagggcttacagagtcatttgaagaagtgtggtgggaaatacaatcagattttggcatttcgacctacaggatggacacactctaacaagttcactagaatagcagatgttattccccagaccaaaggaaacatttcaatatatggaattccttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcagtagtagttaagttccttggatgtagcttgttagtagttaaatctatagaaatgtgaaatacactttgtgtggaaaaacctcatgaagattgttcagatactttattttctcatttatgtttgaacaacatgttcgtggtgctgaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcattatatatataagtaattatgtgtctttaaaattatgagatgaaacttttatatgacgtgtatacttaaataaaattaatataaaa

SEQ ID NO: 23 - DNA, 3940 bp, Homo sapiens
  >DCLRE1B|ENSG00000118655|ENST00000369563|3940
accaaacagaagaccgctgccggtctccccgcgagcgagcgctaagcgtagtcccgactccgaccttaggatgcccttcccccaacctctcactctccaggcgcagctgcgcggctccctctggtggagctgcggcgggcaatcggaaatcggctactttggcctgtctcctccctgcagcgcgcgctttgagtgcccggctcggcctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatctaagcaatggatccaagccctggaggttggtgagagccatgtattacccctagatgaaattggacaagagaccatgaccgtaaccctcctcgatgccaatcactgtcctggttctgtcatgtttctctttgaaggatattttggaaccatcctctacacaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggagatgatgatggaggtccagaagccacagggaatcagagtgcctggatgggccatggttctcccctgtcccacagcagcaagggcacccctcttctagctactgaattcaggggtctagcactcaaatatcttctgactccagtgaactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcgtctggatcaaaactgctttgggatggaacctcgagccctagcagtgaagaagattccatttcttgtccaggggatttaaaagagttttctgctttgagagagaaatagagagtttagaaagcaattgctcttgggaaagctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacaggatgggtctttcagattttggttctctttagcttctggttcttgaaagaaattaatctgtatataacataagaaactttgaaagtcaaaaaaacaaaaaattttaattcctcgtagattaattgatttgctatcttttagtttttttttctatgcatgtagatgtattaaatatgtaaatgtttttcaaagttgaggtaatattgtatagaattttatagcctacattttaatttcttgatatcttaagcatttcacttattagatattgttcaaaaatgccatttttaatatttgtataataccctatcatgtgagtataccttaactaagccattcccatattcaacattttgtgtactgtttttctaattacatatattacaatgaacaaccttatgcata

SEQ ID NO: 24 - DNA, 2354 bp, Homo sapiens
  >DCLRE1C|ENSG00000152457|ENST00000378278|2354
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 25 - DNA, 2422 bp, Homo sapiens
  >DYRK1A|ENSG00000157540|ENST00000398960|2422
gttatagttttgccgctggactcttccctcccttcccccaccccatcaggatgatatgagacttgaaagaagacgatgcatacaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtgatgcctgatattgtcatgttacagaggcggatgccccaaaccttccgtgacccagcaactgctcccctgagaaaactttctgttgacttgatcaaaacatacaagcatattaatgaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacatagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagaggatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtagatcagatgaataaaatagtggaagttctgggtattccacctgctcatattcttgaccaagcaccaaaagcaagaaagttctttgagaagttgccagatggcacttggaacttaaagaagaccaaagatggaaaacgggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtggctcatcggggacaagcaacagtgggagagcccggtcggatccgacgcaccagcatcggcacagtggtgggcacttcacagctgccgtgcaggccatggactgcgagacacacagtccccaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgtttttt

SEQ ID NO: 26 - DNA, 9821 bp, Homo sapiens
  >EGFR|ENSG00000146648|ENST00000275493|9821
gccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 27 - DNA, 4545 bp, Homo sapiens
  >ERBB2|ENSG00000141736|ENST00000269571|4545
ggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 28 - DNA, 5919 bp, Homo sapiens
  >ERBB3|ENSG00000065361|ENST00000267101|5919
attacccttccctggatctgggggctttcggaatctcgacctccccttggcctatctcctgcagaaaaattagggtgagccccatcctcgatctgctccgccaagttgcgggaccgcggggcgtggcacgctcggggcaggcggtccgaggctccgcaatccctactccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttca

SEQ ID NO: 29 - DNA, 4153 bp, Homo sapiens
  >ERCC2|ENSG00000104884|ENST00000391945|4153
ggatgtccacgacccggcctctcgctgaatattcatgagggaggcgggtcgaccccgctgcacagtccggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcagggctctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgcca

SEQ ID NO: 30 - DNA, 2750 bp, Homo sapiens
  >ERCC3|ENSG00000163161|ENST00000285398|2750
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagt

SEQ ID NO: 31 - DNA, 6758 bp, Homo sapiens
  >ERCC4|ENSG00000175595|ENST00000311895|6758
agagcttccatggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagaagtcgtatcaaaaggaaaagggaaaaagtgaacagtgatggctgttttcttatcccatgcctgtacttttcagcggctccttgccagacatcataggtcattattaattattggtttgctatttcattcttttccaatgctcttaatgattgtacggtggaccagaagccaggattcctctctgaactctgcagttaggcatcacttgaacttgcctgtgcctgctctttttcctccctgcaccgtctatgccgggcttagcatgtttctttttaaatgaggtttgtcaggatcaggtaaagttcctacaagtgattacagaaggtagaaactttacctgatcctaacagatctcatttagaaaggaatatgctaagcctggcatggacggtgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactagtcttctaatgaccctaacatatgtagcatatactataatttcattgttccaaattagtatttttaaagcaaaatgaattacctgtttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatcctctagaaatacaacctaattggcagtgagccgagatcgcaccactgcacccctgcctgggcgacagagtgagactttgtctctattacaaaaagaaaagaaaagaaatacaacctaagctcacctgcctgtgattcctcatttctcaccatcctgtgccagggtggctacttctctctgtgaggactcaaatacaagccaatgagtggcccactaagcttttaagatttgattttcctgccttgagataaaaaggagtgtaggtaaatgaaagatcaatgtatggaatatataaaaatacgaaagaaatatatacgtttaaaaatccataaagaaaaaaatctcattctaaacctgattaagttggctttttacgtaagtgtacaaataggatattcacagcatctttgtgcagtttttaaacttttatatttaaacattattaagttggcttttgttcacatgttgagtaatgggtagtaaattttctacctcaggagctgatatagacatcagttctgctagccatatcacatattttaatgtttcatcaacatcagctgtttttttgtttgctacactatttgaactaatagacagtggatcatgtaacacaaaattgtcttcaactttaacaaaattgtcattgttatttttttttgagacagagtctccctctgttgcccaggctggagtgcagtggcgcaatctcggctcactgcaacctcgcctgctgggttcaagcagttctcccacctcagcctcccaagtagctgggattataggtgtgcaccaccagacccggctaatttttgtatttttagtagagacggggtttcaccatgttggccaggctggtctcaaactactgacctcaggtgatccacccaccttggcctcccaaagtgctgagataacaggcgtgagccaccgcacccacccaacaaaattatttttaactgtcgtttctgaactgaacctctcacattggcatcttgatttattggtacttaacagtatatatggattttgaactctacacaagggtataaccagaatgaattgaggggtatcaagaaccagattggttacagtagaactctgtaagatgatgtggagagtaaggaaaaggagaagaaataaaaattagtttaagatggaataaagatttgggctgctaattttttcccaggattcaaaatatacccgctagaatggaaaacaaaaatttgaatgattacaacattatcgttaacattcaattttgtatttattgttttattgaatatagttcagagtatattaaaatagacctaccacttcaaatgataatgattattataatgtctcttcaccctattctagcacttctgcttgcagtatgtggtttctatttttttcctcttgtataattccacttgcttttaattgttgtttcattatataaaaggaacatcttcccatagcatattctatgaaaggggtttcattccaagttgagttttcaaaaaaaaggtcttcctaaagctaccattttcaaccgtccttgttatctagtacaacataaataacagtcttaaaaattgcactaataccagtgcccccctggctctccaaatctgttctttgctcttgtatctgctggacgcttgaagacaggtgcactgtctcgtatgtatttgaattatgaacagtaatttctaatgaattctaaaatggtcattgtaagtgaaagcctctcgctaccacttcctcttccaactacataaatatatttcaatgtatttccagttttggaaagttttcaatacatacatcaagtgtttacttagatttttataaaaattttttttacaatctaataatctttggtaaaggaactagagatgcatgcagttgcaaaattaatgtatttattttccagcataattttattaacttcactttttttctctctagtaaatatccagtgtacttatgaactcatgtttggctcttttaaaaccttttctaaaagctagatcagcatttttctattttacaagttttttgtataaaaaggtgaacatatgagatattgtgagaaatcattttaagtttcatttaaatcatggtgcctcttttgatactttcttaaaattgtgcaagaagaaatcatttttagtagtggtcataaatattatccttttggcagtaagctattactaattcagcctgaagctcggtagacaatatgtctacatgtgtttgagtacatcctggatacagtttcccagctcatgagggactgaaaatagtcttattcatcaacccactaggatgtgaagggttaagtctagatttggtcgcattgaaaccccacaatatagaattaataaatggccttcagtaggaaaacctacactaaagcaaatccgaagaagtggggcagggggaaagaggcattactggtctttccttttgttttgcaagcataatttgattttcctttggctcagaaaactcatttggggaaattctcttttgtgttcagtttaacctagaaaggtcctcttgaaaaaccaacattttaggaaagttcttttttcaggatggagtatattaaaattaagccaggctttgacgtgaattatcacttttctttattattttgttttctattttggtttatagctatttctggttcagttctgaacttcagcacttaatcatccttatcaaccaggcttttggtagcctaaaccgctatgctgttgtttttttaatttaaagatgtataagccaaaatttggatgggagtgagacataactgatttatatgaattttaacagagttgtatttgtgtgtgtttaataaaatatatatttattcagtactttcctcagtattttatgggcaaagtaaaaataacaatgcatagtgaaagggcatatattaccagcagtaataattcaaaatcctgaaaatgtttcattttttttgtttttgttatgcagaataaacaaggcagaaatgctctttgaacc

SEQ ID NO: 32 - DNA, 5076 bp, Homo sapiens
  >ERCC5|ENSG00000134899|ENST00000355739|5076
tttgccaacgttaaggacgcgcagctgtgacacagccccaggaagtccagatgacatgtgcccaaggtggttggggcacagattggttttatacattttagggagacaggagacatcaatcaacatatgtaagtacactggttccttccagaaaggtggggacaactcggaagcaggaagggcttctaggtcacaggtagatgagagacaaaaggctgcatacgagtttctgataagcctttccaaaggagacaatcagaatatgcatctatctcagtgagcagaaggatgactgactagaatgggaggcaggttttgccctgagcagttcccagcttgacttttcccttttgcttagtaattttgggaccctaacattttcacaggctttaaattttattattctttagttactacgtgctagcatataaataaatagtacaaaaccaagaaggcatccaccttttggttgtctcttcacgtgtaaaacaacactttgtgttaagtatcttcacacacggcggcgcaaaggtagaaaccgatactaaaaaagcgtgtagaaaatagttcccagcctgggcaacacagggagacctcatttctacaaaaataattcgccaagcatagtggtgcgcacctgcggtcccagctacttgagaggctgagatgggaaagttgcttgagctcgggcagcaggagttccaggctgcagtgagctaagaatgcgccactggactccagtatgggcgacagcgtgagaccctgtctcaaacaaaaacaaaagcccgttactccaccaagaaggcgcttttgcacattgttttaatgcttaacgccttcaggatgccagcgtgacggaagcaagtaaccaccaaggcatcaccactggcgctaaacttctcacttccggagtgctgcaagcgcagaaaatatacgtcatgtgcggaggcggagcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtc

SEQ ID NO: 33 - DNA, 2869 bp, Homo sapiens
  >FAM175A|ENSG00000163322|ENST00000321945|2869
gccggcgcaggccccgcctcctcgctgggccccgcctcgctgccaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagttaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaa

SEQ ID NO: 34 - DNA, 5451 bp, Homo sapiens
  >FANCA|ENSG00000187741|ENST00000389301|5451
agccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccggcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaa

SEQ ID NO: 35 - DNA, 3008 bp, Homo sapiens
  >FANCB|ENSG00000181544|ENST00000398334|3008
agcgcgctggcgggaggtttggagcagatggataccgtatcgacgtggggcctccggtatgttgccgctgcgttgagtttcataagtacaagccagacctttgatttacctaccctatcttctttactgatgaagctgaaactactttgtgatgcctattgtcccagatctttctgttaattgcctaacaacaaaccagtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagagcctacaaaaacacccatattacatgtcagaagaatggtatttgacagaggaacaaaagtatttgttcagaagtccactggattttttaccataaaggaagaaaactctcatttaaaaatcatgtgttgcaactgtgtgtcagatttcagaactggaattaacctcccttacattgtgatagaaaaaaataaaaagaataatgtttttgaatattttttactaatccttcacagtactaataaatttgaaatgcgtttgagttttaaactaggctatgagatgaaggatggcctaagggtccttaatggccctttaattttatggaggcatgtcaaagcattcttctttatctcttctcaaactggcaaagttgttagtgtgtcaggtaacttttcctctattcagtgggcaggggagattgaaaatttaggtatggttttattgggactaaaggaatgttgtttatctgaggaagaatgtactcaagagccttcaaaatcagattatgcaatttggaataccaaattttgtgtatattctcttgaaagtcaagaagtattaagtgatatatacattattcctcctgcttacagcagtgtggtgacttatgtacatatttgtgcaactgagatcatcaaaaaccagttaagaatatctctcattgcccttactcgaaagaatcagctgatttcatttcagaatggaactcctaaaaatgtgtgccagcttccatttggagatccttgtgcagttcaacttatggattcaggtggaggaaacctctttttcgttgtatcctttatatccaataatgcttgtgctgtatggaaagagagctttcaggttgctgctaaatgggaaaaacttagcttagtactgatagatgactttattggaagtggaactgaacaagtactcctactttttaaggactccttgaactcagactgcctgacttcatttaaaataacggatcttggaaaaataaactattcgagtgaaccatcagattgcaatgaagatgacttatttgaagacaaacaagagaatcgttacctggtggttccacctctagaaacaggactgaaagtttgtttttcttcttttcgggaattacggcagcatctgttgcttaaggaaaaaattatttcaaaatcttacaaagctttaataaacctagttcaaggaaaagatgataatacgtcaagtgcagaggagaaggaatgtcttgttcctctttgtggtgaagaagaaaattctgtccatatcttagatgaaaagttatcagacaattttcaagattcagaacagctagtagagaagatatggtatcgtgtaatagatgatagcttggttgttggagtgaaaactacatcttctttgaagctgtccctgaatgatgtgactttatcattgttaatggatcaagcccatgactccagatttcggcttctaaagtgtcaaaatagggtgattaagttgagtacaaatcctttcccagcaccatacttgatgccatgtgaaataggattggaagcaaaaagggtcacgttgacccctgatagcaagaaagaggaaagctttgtttgtgaacacccatctaagaaagagtgtgtacagataattactgctgtaacatctctttcaccacttttaacattcagtaaattttgttgcactgtactgctacaaattatggagagagaaagtggtaactgtcctaaagatcgttatgttgtgtgtggcagagtttttttaagtctagaagatctttcaactgggaagtacctactgacatttccaaagaagaaacctatagagcacatggaagatctttttgcacttcttgcagcattccataaatcttgttttcaaatcacatcacccggctatgccctgaattcaatgaaggtgtggctcttagaacatatgaaatgtgaaataatcaaagaatttccagaagtgtacttttgtgaaagaccgggaagtttctatgggacactcttcacttggaaacagagaacaccattcgaagggattttaataatctattccaggaatcaaacagttatgttccagtgccttcataatctcatcagaattctccctataaactgtttcctcaaaaatctaaaatcaggaagtgagaatttcctaattgataatatggcatttactttggagaaggaactagtcacccttagttctctttcttctgccatagctaaacatgaaagcaattttatgcagaggtgtgaagtgagcaaaggaaagagtagtgtcgtcgcggctgctttatcagacagaagggaaaatatccatccctacagaaaagaacttcagagagaaaagaagaaaatgttgcaaacgaacctaaaagtgagtggtgccctttacagagaaataactttgaaagtagctgaggttcagttgaaatcagactttgctgcacagaaactgagtaatttataattataatttcaatttgatcatattttaaaatatgttttcaccaccatataagattttggttctacttgctatatgcctcctttgtaaaaataaacaccgaggcttactgtagtagaaactttagttttgatgatgcacaaaataaacagcagtggttctc

SEQ ID NO: 36 - DNA, 4585 bp, Homo sapiens
  >FANCC|ENSG00000158169|ENST00000289081|4585
actgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaa

SEQ ID NO: 37 - DNA, 5219 bp, Homo sapiens
  >FANCD2|ENSG00000144554|ENST00000287647|5219
gtcagagcggcgtcgggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggaggctga

SEQ ID NO: 38 - DNA, 2554 bp, Homo sapiens
  >FANCE|ENSG00000112039|ENST00000229769|2554
aacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgaaaccactgttgctgcgattgccccggatatgccagaggaacctgatgtccctgctgatggccgttcggccatcgctgccggaaagtgggctcctctctgtgctgcagattgcccagcaggacctagcccctgacccagatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggaccagcttcccaggctgcagcagctgctgaagaccttggaggaggggttagagggattggaggatgcccccccagttgagctacagcttcttcacgaatgtagtcccagccagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataat

SEQ ID NO: 39 - DNA, 3309 bp, Homo sapiens
  >FANCF|ENSG00000183161|ENST00000327470|3309
tgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtactccacttaaagccatggaattagcaatagtttgctttttaatagaaggcccatttgtaagaatgttgaaaatatgtgtaccgtttaaagaaaaagcagctttaaagtgacaaacaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgtccctttaaagcattgacgcacagacaaatgtttaaagcacagtaaatacgaatatatgcctttggatattaaattaatgcttgatgataaaagaatcaaacttttttttttttgagatggagtctcgctctgtcacccagactggagtgcagtggtgtgatcactgctcagtgcaacctctgcctcccaggatcaagcaattctgactcagcctcccaagtagctgggattacaggcgcaggccaccatgcccggctaattttttgtatttttagtagagacggggtttcaccatgctggccaggctggtctcaaacacctgaccttgtgatccgtccgccttggcctcccaaagtgctgggattacaggcgtgagccaccgcgcctggccaaaacaacattttaagtagaagatccaggttttagtgcagcttctgccgttaactaggttaataaatcacaaccttggggccacagttgccttatatgtaaatgaagtgtttagaataaaatagttaaatttccttatttttcccttggtggctgccctgtggaaacagtttagaatatttgttttgtgtgtaggaacctagttgtgttagtttacctgggtgttccacagctgatagtgattgccttgaataaattcaagggcaatttattcatttttactagggagatagacctttacagcaatcaagatatttttgtccatatccaggttagctggtaagaggatttttttggagaaaaaaatgatatttagaaagttaatttctaattccggaatggaataaaaacaatatgagtagtgtaatcttgtagaaaaagagttgtataatcttgtagaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtcagttgcgtgaattttttttaagaaacaacccagtgaagagttctaccatagcaaggcctaatgttagctttagctttagaaaataacagtttgtgaacttacttccctatatttgcagctgtatctcacactatgatttacaataaaattgtaaagattgacaatagacttaagaaataacattttaaaatctattttatacttaccatttattattctgttattttagtctccatatgttcattacatacataatcttatttaatcttcacaccaaaactgtattcttatgaatatacgctaaaagattaagtaaaatgcccaagggtataaacaaaagcaacatgaaagtggaagccgtatctgtcatttattttatttccagaagcctagcacagtgtccagcatatggtagatacttgtagtgtttgaataaatgaaaccagcattagagctttatatactttctcttaaggacttgaaaagattaggaatctacgcatacactgagagagaaaaaagtgagagga

SEQ ID NO: 40 - DNA, 2631 bp, Homo sapiens
  >FANCG|ENSG00000221829|ENST00000378643|2631
aggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttat

SEQ ID NO: 41 - DNA, 4743 bp, Homo sapiens
  >FANCI|ENSG00000140525|ENST00000310775|4743
gttgttacgggtaacggaagtgtggcggcgttgggttgagcgggctttttggaagtttgtggcggagttctgtgatatgagcaacaatggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagggatagtatccaaagccaccaagaaagcctttctgttctcaggtccagcaatgagtttatgcgctatgcagtgaatgtagctctgcagaaggtacagcagctaaaggaaacagggcatgtgagtggccctgatggccaaaacccagaaaagatctttcagaacctctgtgacataactcgagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaaca

SEQ ID NO: 42 - DNA, 1698 bp, Homo sapiens
  >FANCL|ENSG00000115392|ENST00000402135|1698
gtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcaggtaaattctcctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaaga

SEQ ID NO: 43 - DNA, 7111 bp, Homo sapiens
  >FANCM|ENSG00000187790|ENST00000267430|7111
ggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggaatgaggcaaagtagcctaaagaaagattggttcttatcagaagaagaatttaaattatggaacagactttatagattaagggacagtgatgaaattaaagagataacattgcctcaagttcagttttcttctttacaaaatgaggaaaacaaaccagctcaagaatcaaccactggaattcatcaactctctctctctgaatggagactgtggcaagatcatcctttgcctacacatcaagttgatcactcagatcgatgccgccattttataggccttatgcaaatgatagagggaatgagacacgaagagggagaatgcagctatgaattggaagttgaatcttatttacaaatggaagatgttacctcaacatttattgctcccaggaatgaatctaataatcttgccagtgacacctttatcactcacaagaaatcgtcatttataaagaacataaatcaaggcagttcatcctcagtgatagaatctgatgaagaatgtgctgaaattgttaaacaaactcatatcaaacctactaaaattgtttctttaaagaaaaaagtgtctaaagaaataaaaaaagatcagcttaaaaaagaaaataatcacggtattatagattctgtagataatgacagaaattccactgttgaaaatatttttcaagaagacctaccaaatgataaaaggacatcagatacagatgaaattgctgccacatgtactattaatgaaaatgttattaaagaaccgtgtgtgttattaacagagtgtcagtttacaaataaatccactagttcacttgctggaaatgttttagattctggttataacagtttcaatgatgaaaaatctgtttcatctaacttatttcttccattcgaagaagagctttatattgttagaacagatgaccaattttataattgtcactcattgacaaaagaggtactagctaatgtagagagatttttatcttattctcctccgcctctcagtggactctcagacttggaatatgaaattgctaagggtactgcacttgagaatttgcttttcttaccctgtgcagagcatttacgaagtgataaatgcacctgtttgctgtcacattcagctgtgaattctcaacagaatttagaattgaattcacttaaatgtataaattatccatctgaaaaaagttgcctttatgatatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctagtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttataaa

SEQ ID NO: 44 - DNA, 3702 bp, Homo sapiens
  >FBXO18|ENSG00000134452|ENST00000379999|3702
ctgctttcaaggtgtctagatacagagtgaagaatgtcacagtaggaagtgcactggactaggggagtcaggagacccgggttcttgtgttggcaccatcactcatgagctacgaggtgacttcaggctgccattggacctgtcaagtgcctgagtcatgtgataatgggctacattgcgcagggcccctgggccatctccacaggagatgccagaggacgagtgcccacttgctggtcttcacagagcacgctgaaatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggca

SEQ ID NO: 45 - DNA, 4977 bp, Homo sapiens
  >FBXW7|ENSG00000109670|ENST00000281708|4977
cccgcccctctctctggagtgaggcgagagccccgcacagagcgagggagacagcgagctgagctccgggcgctgccgctgccgctgccgccgccgccgccgctgagactgagagcgaaggagcatccgagagatccagtccccctgcactggccgccgccgagaccttcgctctcacctgggccagcgggagccgcggccgcactcctttccccccctcaccttcccggccggcagcggcggctgcacacgccggagccggagccagagccggagcccgagcctgagccggagccggcggcttggggggcagggaggcggctaccacgggccgggagtgggtagctgctccgcggtgagagaacgctgaggaggcgccagagcttctgcctcgtcccgtggggcgtggggcgagacccccaaggtgtagggaggggggtcccagccgcagcgacacatgcgggagccgggagcgggggcggcgccgagcggagccggccgggtccctcgccttgccgccgactcggccacccgcccggggccgtagcatcttgccccggagtgtatgaaccggggccccaaccaagctcggcaaccaccccccggccgggggggcggggaccccgatgtgaagcggcggctggggcggcggagagaacaggaccgacgccgccgtcctttcctcaccttccccctcccctcagccccctccgggggtcttctcccttggccagtcgccggccccccggctccttggctggactccgggaggagttcctagagcccccctcccccgccccagtcccgagggcggcggggccgggggggacccggggggccggccgcagcctccacccagaggaaactttacaaaaacaaaatccggagtctcccaaacctgactgtcccgggagaagtggccctggacgggcagaagccgcagcctgaaaagacccaggaagaggaaaagaggaggtaagcggggccgccgcctcccctcccctggcagcgcggaagagacccgggttgccgcctggtttagcgacacgagcaccgcttcttcctcagtaccgcgccggagccttccgcagctgccgcttcagtccgaaggaggaagggaaccaacccactttctcggcgccgcggctcttttctaaaagtaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgtta

SEQ ID NO: 46 - DNA, 2296 bp, Homo sapiens
  >FEN1|ENSG00000168496|ENST00000305885|2296
aaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaa

SEQ ID NO: 47 - DNA, 6367 bp, Homo sapiens
  >GEN1|ENSG00000178295|ENST00000381254|6367
gaaacgcttcctggtgctcctgggcctggcggttgagcccggggagctagtctttgcttgggtaaagaaagaggactttcctttttttttttccttttgagaaaattcagaaatttggaggcacagtagttaggattcaggccaaactggtaaatgacgaaggggcttcttccagagccaaggaggaagggttgtccggcagataatcaccagaatgggagtgaatgacttgtggcaaattttggagcctgttaagcaacacatccccttgcgtaatcttggtgggaaaaccattgcagttgatctgagtctctgggtgtgtgaggcacagacagtcaaaaaaatgatgggcagcgtcatgaagccccacctcaggaacttattttttcgtatctcatatttaacacaaatggatgtaaaactggtatttgttatggaaggggaaccaccaaagctgaaagctgatgtcataagcaagaggaatcagtctcggtatgggtcttctggaaaatcgtggtctcagaaaacagggagatcacattttaaatcagtcttaagagagtgcctccatatgctcgaatgcttaggaatcccctgggttcaggctgctggggaagctgaagccatgtgtgcttatctcaatgctggtggtcatgtcgatggctgcctcaccaatgatggagatactttcctttatggggcccagactgtttacaggaatttcactatgaatacaaaggacccacatgttgactgttacacaatgtcatctatcaagagtaaactaggtttggatagagatgctctggttggattagcaatacttcttggctgtgattatctcccaaagggagtccctggagttggaaaagagcaagcattaaaacttatacagattttgaaagggcaaagtttacttcagaggtttaatcggtggaatgaaacatcttgtaactctagtccacaactgctagtcactaaaaaactggctcattgttccgtatgttcccatccaggttcacctaaggatcatgaacgtaatggatgcagattatgtaaaagtgataaatattgtgagccacatgactatgaatactgctgtccttgtgagtggcaccgtacagaacatgataggcaactcagtgaagtagagaacaatattaagaagaaagcttgctgttgtgagggattcccattccatgaggttattcaagaattccttttaaacaaggataaattggtgaaggttatcaggtaccaaagacctgatttgttattgtttcagagatttactcttgaaaaaatggagtggcccaatcactatgcatgtgagaaattgctggtacttttgacccattatgacatgatagaaagaaagcttggtagcagaaactctaatcaactacagccaattcgaattgttaagactcgaatcagaaatggagttcattgttttgaaatagaatgggaaaagcctgaacattatgctatggaagataaacaacatggagaatttgctttattaacaattgaggaagaatcattgtttgaagcagcatatcctgagatcgttgctgtttaccaaaaacaaaagttagaaattaaagggaagaaacaaaaacgtattaagcctaaagaaaacaatttgccagaaccagatgaagtaatgagctttcagtcacacatgactttaaaacccacatgtgaaatctttcataagcagaattccaagttaaattcggggatttcccctgatcctacattaccacaggaatctatttctgcctcattgaatagcttgcttttacctaaaaatactccatgtttgaatgcacaagaacagttcatgtcttctctaagacctttggctatacagcaaattaaagctgtcagtaagtctctaatttcagaatctagtcaacccaatacctcatctcataatatatccgtgattgctgatctacacttgagcactattgactgggaaggtacttcttttagtaattctccagctattcaaaggaatactttttctcatgatttaaaatcagaagttgaatcagagctatcagccatccctgatggctttgaaaatatcccagaacaactgtcctgtgaatcagaaaggtacactgcaaacataaagaaagtgttggatgaggattctgatgggattagtcctgaagagcatctactttctggcattactgatttatgtcttcaggatttgcctttaaaggaacgaatatttacaaaattatcatatcctcaggataatctacaaccagatgtcaacctgaaaactttgtccatacttagtgtaaaagaatcttgtattgctaacagtggttctgattgtacatcacatctttcaaaggatcttccaggaattcccttgcaaaatgaatccagagactctaaaattctaaaaggagaccagctgcttcaagaagactataaagtcaatacttctgtcccttattctgtcagtaacacagtggtaaagacctgcaatgttagaccaccaaatactgctttagatcatagtagaaaagttgatatgcaaaccactcggaaaattttaatgaagaagagtgtttgccttgacagacattcctctgatgaacaaagtgccccagtgtttgggaaagctaagtacacaactcaaagaatgaagcacagttctcaaaagcataattcatcccatttcaaagaaagtggccataacaagttgagtagccctaagatacatattaaagaaactgaacagtgtgtcagatcttatgaaacagctgaaaatgaagaaagctgtttcccagattcaacaaaaagttctctgagttctctacaatgtcataagaaagaaaacaactctggtacttgtttggatagccctcttcctttacgccagagattaaaactaagattccaaagcacttgaaatttaaaacacttaggtataacttaactattttagtactatcagcaatagcagagacagagggaaggtatctagttcatgtgtggtaaaaattttaatgttctctgtgtcatgaaacacttgccattttaatcaaagttgtaatttttaaaaagtcacctaaaactctggttttaaaagatcctctgtattgaaaacttctgataatgtatgtcattatgtccttactattccttaattgtagttttaaaatattggtatagtacttgacagagtaaatacttcatctgattgttcatttttactttttcttccacaagcctctaaagtatttatattccagcttgttcccaagaggataattctttatacttctcttcattcttttaaggccttgcaaggtcttccgttataactcgctttcctaaaagctattttctccctcagtgtgaagatacctttagtgtgctcttccactttggaaggccatgcaaggtgttccattataactctttttcctaagagttatattctccctcagtttgaagatacctttagtgtgctcttccacttttggtgtcttagtctcttttgaggggcaaaaatagaaaaggagagaagatgtcagtatgtttagtaaaaatcatgctcgtaatggctgaataaactgagcaaagtaactccttatgtatccccagaagttcacaggtatatcgggtggaaaaagatttggaaaatcaaatgtataaccaaaaggattagaaactagcccaggatcacgtagctaactaataatcctgtgggaatcagttttcttgcctgctaatttttttatttttctattttttccttctatagcacttttcccccttttgttttgaatctatgcaatattgactttaataccaccaaatattaagtcatgcattaatttaggtcgcactcaaaaattctagagaggcatccagattgaaaaggaaaatggtgtctgcagatgacaagattgtatgcatcaaaaattctaagaaatccactagaaaactattaaaactgataaagcgagttcatccaggtcgtagaatacaagaccaatgtgcaatgatcattgcattttgtttttgtttgtttgtttttttttgagacagagtctcactcttgtcgagactggggtgtagtggcgccatcttggctcactgcaacctctgcctcccaggttcacgcaattcacatgcctcagccacctgagtagcagggattacaggtgtgtgccaccatgcctggctaatttttagtatttttagtagagatgggattttcccttgttggtcaggctagtcatgaactcctggcctcaagcgatccacccatcttggcctcccagagtgctgggattacaggtgtgaatcaccatactcagcctcaattgtatttctgtacacctctaaataaatggaaatacattccatgttcatgaatcagaagacataagatgaccatactccccaaactgatctacaggttaaatgtaattcccattaattccagctggtttctttgctgattctaaaattcatatggaaatttcaggaacacagaatattaggaagaatcttgaaagagtttgaatgacccacccttcctgattttaagtatacagaactacagtaatgaatgtgttgtactggtataaaggtagacatataggtcaatatagatcaatggcatagaattgagaattcagaaaaaaagccttcacgtttatggtcagttgattttaaaccagagtgccaagacaattcaatgggaaaaggaaacagtctttgaaccaactgtcttctggatctattggatatctatgtaaaaaagagtgacatttgattcctacttcacatgatatttaagaagtaacttaagatggatcaaatacctaaatgtaagctaaagctataaaactcttagaagaaaacatagacgtaaatctttgtgactttggattaggcaaggatttcttaaatatacccaaagcataggcaacaaaagagaatacacaaactggacttcatcaaaactaaaaactgttgtttgaaatgacaccatcaagaaagtgaaaagacagcttacagaatgggagaaaatatttgcaaatcataaatgtgataagggacttgtatcttggtggtatataaagaactcgtaactcaattataaaaagacaactttgaaatgggcaaaatagctcaacaggcttttctgcaaagaagaaatacaaatgaccaagaagcacatttaaaaattttcagtactattactcatcaggaaaatgcaaatcaaaaccacaagacacccaatgtctacaatcaaaaagataataactagtattgatgaggatgtggagaaattgaaattctcataacatgctggtaggaatgtaaaatggggcagccactttggaaaaagtctggtagttcttcaaatggttaaatgtagagttacgatatgatccagcaattcctctcccaggtatatacccaagataaatgaaaacttatatccacataaaaacctgtgcacaaatgtccatagcagcgttattcataatagcctaaaagtggaaacaatcccagttccagaatgaggaaggggagaaactaatgtgtattagctattgtgtgctaagcattcaactagattatttacaaaccttgtatcatctcaactctttaaggactgtattgcaatgttttgaatattcagagagaaaaaagtcgttgctaaaacattttccaaggttctgcttattctgatttgttcagtcgtggctgtgatagttcaggaccatctagaccaggtaaataaaatatctagaggcattcttgagattgtatgagatgaaaataacaaaattagttgggagtggccagtctgagttcattttgctatatagctcaggagtccccaacccctgggctatggacaggtaccagtccatcacctgtcaggaaccggcctgcacagcaggtgttgagcggcatgcaagcgagaattaccgcctgagctctgcctcctgtcagatcagcggtggcattagagtctcataggagcatgaaccctattgtgaactacgcatgcgaggatctagtttgtgcactcctactgagaatctaatgcctgatgatataaggtggaacagcttcatcccacagccatctccccctcatcatccgtggaaaaactgttttccacgaaagtggtcctcggtgccagaaaggttggggactgctgatatacctaatataggcataagtgtaaaattatagttcctcctcctcaaggatttctctgttttcattgtccaggttataccaattctttttaaagcattccatgttcttgttccttgatgtggtcatgttatcacttgtaaat

SEQ ID NO: 48 - DNA, 1614 bp, Homo sapiens
  >H2AFX|ENSG00000188486|ENST00000530167|1614
acagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaatggagcgtttgttttcattt

SEQ ID NO: 49 - DNA, 9874 bp, Homo sapiens
  >HDAC2|ENSG00000196591|ENST00000519065|9874
gcaggttgttcaccctaacagggcctctaacctcgagcccgaaacggcctccttctccagccgtgccccttcctcccccgtggaggccgcagtggatgcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagattaacatcccattacaatttatgaaataatacagactctgcaattgagatgtaggagttctttgagttgacccaaagattctcaaaattgaaatggaaattctgaattgaaagaagaaactgaccagaacttgtattgaccagacttgcctatagtatattgctggtttaaaatggaacctgcagacaaaacctgtttcttttactgcatttacatggcatccaggttccattattatttacgtgacatccaggtttctaactcaaggaaataaacacaactgatttatcattcagcaactacttattgtgtgtctgcccattttaagactgtaggagtgtaactgaatataatggaaaaatgctttcactcagagcttacactcagagcttacattctagtagcaggaagcagacaaatgggggtaactcctgctactaagatgtgcaaagaagacaaaacattttaggaacttgccaaaatcagtgaaatctccctttttgtcaggcccacattgattcttttgagattaaaaattacagaatgccagaagataattcagtcaaaagtatttctcttcagtgcagtaaaatattaaaagaaaaaatatttctctacaagcctcttaaatgtttcagacattcacaatagcacctagacttttgtaatgaacagctgtgcacccaccccgacttaacaaatattttacttttgctatatttgcttcggtgtttttttcttaaaatacaccgaaattgaagctctctttgtgtactttgtcgtttgtaatcctccctccctcccagccttaagaagtaatcaccattgtgattattttatccatgtttttgtgaatattttacccatgtttttgtacttttgctacatatttgttatcaatctgtaaacctttatgacattaggaactaagaaacttagtcccttcgttagggggataatgaaatgtatttagtgtttgtgaaacatagatggtatgtatttggacaattctgtaactttgctttttttatttttatttttccatagcttattggggaacaggtggtgtttggttacatgattaagttctttagtggtgatttgtgggattttggtggacccatcacccaagcagtgtacactgcaccctatttgtaatcttttatccctcgcccccctcccaccatgcctcccgtctaccatgatgatcctgttttaaataagaaaataccatttcgcaggctccagatgttctggcatcctccctgtggatttcccagtgcctgcagctcacaggacaacaggggctgtggtagagtcacctatgagatcctggagtagtggatggaggagatggaacagtgaagacggaaactgagctcagtatccgggtgccaggagacaaaggccctttgctttttttcatttaatattctgatctacccctgttgacacatgttaagtatagttcattttgactgctatgtattatgttccattgtgtgaacatactgaaattgtacacttcaatactatactggatctccttgggtgtatttaagaggttttgtttttctaagtagttggttatatacaactaaaacctcaagagaactatctaaagcaatttcagcaaggtgatttggtacagcattaataaacagaaatcagtaacacttagtgaccaagtctgttggaagaacaaagacccccatttgtaataacaaaatttttagaaataatatgtaaagaagctatggttcttgtgtctagtaaggtcaatgtaacatagtaagatgtcagaataccctaatactttaaaaaattcatataggataaaaatgatatttgaaattggcaaggaaagacattattttgtaagtggaattgggacaacaactggtaaccaaatggaaaacccagttttctgccctccactagaagatttaaataggaaaagataaaactaccaaaaacctaaactcttaaagcaaatggattgaagaaggcctaagtgtgacaccaaactcaactataaaagatatatttgataacaaaaaaaaaattagttcagtggaccaacaaaaacttagaagacaagtcaagaaaaatgacaaaagacagagtgggaggcagatttgtaactcatccaggtcaaaaggctcatatctaaagatagtagaggaacaaaatgtataaggatgtgaactgggaaacaaatacatataaatagtttgtaaatatgaaaagatctttaacctcagtaaataaaaagctatagagagacttattttttaacttagttttttaaacctattatgtttatttattttttctttttttgagacggagtctcgctgttgcccaggctggtgtgcaatggcgcaatctcggctcactgcaacctccgcctcccaggttgaagccattctcctgcctcagcctcctgagtagctgggattacaggcgcctgtcaccacgcccagctaattgttcgcatttttagtagagacggggtttcactatgttggccaggctggcctcgaactcctgacctcatgatccacccaccttggccttccaaagtgctgggattacaggtgtgagctgccgcacctggctgtttatctcttttttttagagaaaggatctcggtcacccaggatggagtgtggtagcctgatcatatctcactacatcttagaacttctaggcttagggtattctcccacctcagcctcccaagtagctgggactacaagtgtgcaccatcacacctagctgatttttacatttttattttggagagatggtgtctccctgtgttgcccaggctggtcacaaactcctaggctcaagcgattctcctgactcaggcatgagccaccgtacccggcctaaacctatcatgttacagacttagaaagcaactattgtcaagtgtttgaggaaactcaggtcaggtttggtaaactaagatattaactcaagtaaagctctttaattcatttaatgaaggtgccacattgtctcagttctctatggcatgggtgaatgctgttctaagtcagcattggtactctaagctagttacatcatatctaagctttgcccttctaccagagctgctagcattctgtcaatgggcaattatttgaagttcttacattgaagttagtcacctacatcttctgttttttatggttttgatgtagtaatactgctgaagtttttttgataactgcgattcataatatttgttattcatattgtgatataaatgataagggcttttgaaaacaagtagtaatcatttcaatagcttaggatctccaccataatcttaggaaaattactaacctctgtgcctcagttgcttcatcatttaaaatgaggaaaataatagtccctacttaataggtttgttgtgaggattgagttaataacatagttaatgctcagtaagggttagctgctatttttttttcttttttttttgaaagagtctcactctgttgcccaggttggagtgcagtggcatgatcttggctcactgcatcctctgcttcctaggttcaggtgattctcatgcttcagcctcccaagcagctgggagtacaggtgtgcaccaccacacctggctaatttttgtatatttagtagagacgggttctcaccatattgtccaggctggtcttgaactccttacctcaaatgatccacccgcctgggcctcccaaagtgctgggattacaagcatgagccaccgcgcctggcttgctattgttatgaggtaaaggtagatagatgggtgagagtggtgccaggggaagtgttaaatttttgagtgttcctttagatgccagatgggttgtatctgagccttttattgcagtttgatgcctactagtgtgaagactactaggtcatagtggatagagaagcaatcttttggagacctgattttagcaaggatacgaataatatttgacaactttggggggatcttgatgcctctgtaatttactcaaggataatctcaagaaaaatggcattaagtagattacagaaaaaatagaactatcatattgttattattggctatttacatgagcaatgcggagaaatgtttaggattacagcatttagaagcttctcaattgctgcatttcctcactgtaccacaagatggcagatactgcatttaaaatttttttttctgtgtgttttctcttatagtcacttggtggccatgtaacaagcagagcaacatgtattaacagattctttttgaatgcaatattggattaaaaactttgaattaaactacaattaagtttactgatttaggttttcctataagaattataacactaatttctaagttttacatctgcaaaacacagtagagtgtatctggtagtcattgactaattgtgactttgctagtcagacaaaatggaactgaatattagagccagaataattttctgttttgactggtggtaagaatcagttagtatacagaatgggaaagaattgaaatttatttctaggaattatagttatagtgaagttaatattcaggggcattgggtgcttgttccacgacttttgtttactgaactaagtacctaacccctttggtctttgaacactgcagagttatgattaggattattaatgaaaaattcttttttagtagaacaaacagttaaggacagaagacaccttgattagattctgttatttgctctttttattaagattgtttttactctaaatgttaaagaaatgtataattatttctaaggtaaaatgagtagcaggattctgaataggagattttttttggccagacccattttgcagccagtggtttgtatttaggagtgagttgaacaaagaagactctaatctgtttttgtgttgtggattttttattctattgataaatcagtagcttccagcttctcttgtatcctctactagtcatcttttttgtttcttcagaaataaacatccagggtcacttccctgcccttgccatatacttactaggatgatgtacaggtaaaacttttaaaggaaagtacggacaggcaattcctaaagtaaaagagagcacattatcaaaactggctgtacttaacaaataccaacaaaaagtcattacacttctggcaacaaataatgtttgatttaaaaagacaagaatttccccttttgctcttattttttaaatatgctatgtccttaagtgagaaatgcacttcaaaaattttcttattctgaagtctagccggaaagtttgaacttgtgttgcctttggctagactaggtgaaattaaggggcttaagagggcactgttgtgtggccctgtggtagataatagccctccaagcatgaggatgggagatctaccattcaccagtatttccaaagttatattcttaaaaaggctagatttctaatttccgtagaatctaggtatgttcttttcaactcagcatctgataagaaagtttgggcaagtaggtgcgaaaaatttactctagataccattttccaggaaaaaatataattcaagtccaacgtattactagctgtcaccttccccaacaatcaaataagcattgttattgtcaaacacatttacttgtatagttcagtgttatatgtaatggacttaggtataattcctgtgctattcccttttgatgccaaacacccttttgtaagctgttttgtttgaaatccaaatttatatgtcttaaagtaaatggcagcattgggctttcttaatgtaatgactcttctgccatcctatttctagagttaggcagaaaattctgtaaatctatcttatttccagtctgtttgtgactatggtgggcaataaatctgatttcccagaaaaacacatctggacccctataggtaaggtaaacaagcctcatcttaaattgtttgtacttccgacctgacctcaaaacaccatcatcatctagagcagcaacaagtaaagaacaatgcactggaaatcacatatatgggtctagcaccagcctttacattacacaactttgctttgggcaagtcatttaaatttctgtgcttcagtttactaaatctatgaaactgactaggtaacagctgacatgcttttccagcactccgtcttttacctgtctgatgtcacaaattgatcattcctttctggccttgagatgcgtatcaacccagatagtcattaacccagatagttggcattcaggataaaatgtttttgcctttcctgtcctgcaagctctttaaagtccaaaatatgcctttatatctttatgtgtaataggtatgaaatctatttcttggttgttgaataggataggcttattagacattctaaagtcaacttttttctcatatttaaacatttacccgtagaaattcagttttttaaagttttaagtcagttgattgtaccaaacattactattaaaaaaaaatcaaagtcagagaccagagtttccctgcatcagcgttcagtcaggagacaggaactatactaatttgaacatgtaaagttaaatataatccttaataataacaggattggaataagggataaaagaaagagaattccttctatatatatgtatacacacacatatatatatatacatgtgtatatatgtgtgtgtatgtatattatataatatacatacacacacacaaagaatgtcagacaaggagcagccaccattctgcttactttcactggattaagagtttcataagggcaagggttttgtttgtcttacactccactggggattaatctccagtgtctagaacagtgcctaacacataaataaagcctcaattattatttgtggaatggaatggaatttgagtgaaatggaatgggaatagaatggactggaatggaaatagaagtgggaaggggaatggaaggggatagaagaggattgaagaggacagaaggagatgggataagatgggatgggataggatcgaatctcaggtccaggagtcagaataactgaatcctattccagttctgccatcaacaagtcctgtgaaatttggaaagtcacttaaccctctggccttgtagaatatctcagtgggcatgtctgatgtttcttcatggttagatataggttgcatgttttgggcaagaatatcacaggaatgatgctgtgttctcagtgcacccagtcaggtaatgcatgatttcaatttctctcattactgatgatgttaactttaatcacttagtgaatgagaacatgagcatcattttgaaagcaaactgcaaagttttgatgtcaacattttagcaattacgtataatttcccccaaggatactggctttgagataatgtaaatatacatgggaaagacaaagctcaaataaaggaaaaagaccca

SEQ ID NO: 50 - DNA, 1151 bp, Homo sapiens
  >HRAS|ENSG00000174775|ENST00000451590|1151
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttg

SEQ ID NO: 51 - DNA, 1119 bp, Homo sapiens
  >KRAS|ENSG00000133703|ENST00000256078|1119
ctgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagggagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgt

SEQ ID NO: 52 - DNA, 4103 bp, Homo sapiens
  >LIG4|ENSG00000174405|ENST00000356922|4103
ccacagcgctgtagactgcgccgcattagaagcctggcctcctgatgctgtgctcttcatctagacccaagccccaggtcgtgggacgatttctcccgtttttgactccctggaactgtattgcctgctttacctgcgtacatgttgattctttctcatggcaaccccgcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactattaaaataa

SEQ ID NO: 53 - DNA, 7576 bp, Homo sapiens
  >MDC1|ENSG00000137337|ENST00000376406|7576
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 54 - DNA, 2752 bp, Homo sapiens
  >MLH1|ENSG00000076242|ENST00000231790|2752
gccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataatttcttatttaattttattatgtatatattgtgtcagttcagatgccaaaaagaggtcttgaacatgtcaca

SEQ ID NO: 55 - DNA, 7896 bp, Homo sapiens
  >MLH3|ENSG00000119684|ENST00000355774|7896
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttc

SEQ ID NO: 56 - DNA, 2746 bp, Homo sapiens
  >MRE11A|ENSG00000020922|ENST00000323929|2746
agccaatgagagccgaactggacttgaagcatctacgttatccatgaagtgtcgcgagagaaacggacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaa

SEQ ID NO: 57 - DNA, 3307 bp, Homo sapiens
  >MSH2|ENSG00000095002|ENST00000233146|3307
gcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttga

SEQ ID NO: 58 - DNA, 4092 bp, Homo sapiens
  >MSH3|ENSG00000113318|ENST00000265081|4092
ccgcagacgcctgggaactgcggccgcgggctcgcgctcctcgccaggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcggccgcagcggccgcagcgcccccagcgcccccagctcccgccttcccgccccagctgccgccgcacatagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacagagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcgcagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctc

SEQ ID NO: 59 - DNA, 7476 bp, Homo sapiens
  >MSH6|ENSG00000116062|ENST00000234420|7476
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaccatttttccattttctttctaggaaattaaacccttttaattcttatctaccttctacataatggttattgaatactccacaatatattaagtctagatgttatggtacatgcatacactttcaggctgttttatacccactgtcaccaatacacataaatgggggaggaaaagctatgaaactgtatagggctgtatatatacttgtctcagcttaatgcaggaaattggtttaatttccagcagttttgtctaaactgttcaaaaaaaaactatgaacagagttcaaatacaggactgtttgttttgaagagactttctaaagtgtacttaaaacatagtagttttttacctttcacaaaactgagttacaagaatacttttgttttacagtgcatcccttcctaggaagtctcattaaaacactcactttttctaggggtgattttgaatgctgcacagggaagggaaggaaataatagtcttaacttttcttaaaggataccagaaacattgctggatataatttaagattagtgttttctctttcatagaaagaacgtacatactgggacatgagtacagttacagcaagtctaggtgtgctaacaaaacagggcacattcaagtacagtaagattttgcttgaaattaaaaacaaactacatgagattaaagcattaaaatcatatttctcaatctgaatacatgttaaaaaaaaaaaatcaaaaggaacgcagaagtgctagctcacatttttaccatattacaaaagcaattggtacccatgtccataaaggcagcaacaaagctgcttgtctattgaagattactactgcaaattggactgcattcaatgctagttgtaaaaacaccagcttttcagaagttggtatctgtacaaaattgcagcttattttcttcacttctgtcccttcaagtctttacacagtaatgctaaaacacccagctttgagatcctgagtcaatatattgccactttctttttggtagcttgagcttcatagtgtcaactgaccttgtgtatccatttttaatacagtctcttcctgtagcatgggcaaatattttaaatcttcttccaaaaaagtgttttaagttatgatgttacaatggcaggactttttctttagggaaggaattcagttgtgctgcaatgtattagattctataggtggagcagagtcatatagtgtatctgtatcatgtgtaggctcaccagctaatgtacaaggattagacagtgttccagcaccacagtcacagaaaaacctaaagcaaaatgaaacccaaatattagaaaagtgagggggaaagtaattgggtaatatatcaagcaagtgtgctacatacctatcatgtctaataaactctacatcatgtccctgatggcacttcttaatgcagttcacacatatggcatttcgatctgtggtgttacaagtatgacatctaaaaagcaaaagcttaaattacttttctcaaacatgtcattaatgcaaaacattccattctgtttatatattactatgacctttggctttaagaggaccaaaacaaaattctttgtggctccagcccagattaattctgaaaaggaactttaatggagtaagtgattttcctgtcatctgtgtcttcggagggaagagaaatgatttgtaaattgtataaaggcagttctttccactttaaaagcctctcaaatgtttctgggctgaaaacaatttttggaggcgtgaagagtcaaaactgtcacagtgactgggatatatcaaacacttaaccccgacatctttaccttgaaatttctaggaaaacattacacaacatgagttacatgaatgacatcagttactgtagcattaggtttttccatagttatggtctttgttttgttttgtagagacagggtctccctatgttgcccaggctggtttagaactcctgggctccagtgatcctcccacttcagcctcccaaagtgctaggattacaggcataagccaccacgcctacccacagttacagtcttaaacacgatcttcaagtagattgatgataaaattttcagttagttatagtctcaacaccggcaaatagccaaaaatgctaggcattgctaatttaaaaaggaaatcagtcttcctcttttcaggactcaaatatatttctaagttacctgtagaaatcatgcatgggatagctggtataacttgatattttatataaacattggcctctactaacagccttttctatggcatcttgattgttcattattttgttatctgtaataaaagaaagaataagtaaaaattcagaggaatgttaatattttaaaaaccaaagattataggattattctaacagaagagccactatttttaagagctttaaatgaagctaaccaatgaagtaattgtaagaaatcagctaagaatagaattttccttgtataagatactccaaccatttagaaccaaagctctgtttctttcaaaatctatcttaaactgttgctaacttggagagtgacataaggaatcaagttataaaacggcttctgattatctttcatggcatattgcatatatttataggtatagcagactccaacatacctttcattgtcacattaacaccagatgctaaaaataagcctccaaaccggttgttaaaaatctgattgccttctagtgttgcagttgcgtgatttgtaatttcaatacctgaagtaaaatttacaaacaagtagatacatcactttatactgcttcttaaaaacctgaaattagcaagcaaatgtaaactgcttcttttatagaagtacattaaccctcttaatgtctactgaataaaatgtagatacctatttcaaccaccaacagtaacattcacttatcaatgactatggtcaaaactgcaattaactttcgcaccaacctaactgtcttaaagtttaaatacatgatacttggatttcatttgcatccattttaacatctctttttctgttgcagatttaaactggtaaattcatctgaggaattgaatctatctgtattcctagtggtaatacaagcctgcatttattctatcccaataaatgtttcataatcacga

SEQ ID NO: 60 - DNA, 2345 bp, Homo sapiens
  >MYC|ENSG00000136997|ENST00000377970|2345
ctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaa

SEQ ID NO: 61 - DNA, 4666 bp, Homo sapiens
  >NBN|ENSG00000104320|ENST00000265433|4666
aagtcgcactcccgcctcatccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagtt

SEQ ID NO: 62 - DNA, 4449 bp, Homo sapiens
  >NRAS|ENSG00000213281|ENST00000369535|4449
gaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 63 - DNA, 4003 bp, Homo sapiens
  >PALB2|ENSG00000083093|ENST00000261584|4003
gcccgcgtgggtcagctgatcgcgcactgagggtgcgatcccgggctccccattccttcctggggcgcctccccggcccagggccaactgggtcccggtgtcggcaggcctggggtcggcgacggctgctcttttcgttctgtcgcctgcccgatggacgagcctcccgggaagcccctcagctgtgaggagaaggaaaagttaaaggagaaattagcattcttgaaaagggaatacagcaagacactagcccgccttcagcgtgcccaaagagctgaaaagattaagcattctattaagaaaacagtagaagaacaagattgtttgtctcagcaggatctctcaccgcagctaaaacactcagaacctaaaaataaaatatgtgtttatgacaagttacacatcaaaacccatcttgatgaagaaactggagaaaagacatctatcacacttgatgttgggcctgagtcctttaaccctggagatggcccaggaggattacctatacaaagaacagatgacacccaagaacattttccccacagggtcagtgaccctagtggtgagcaaaagcagaagctgccaagcagaagaaagaagcagcagaagaggacatttatttcacaggagagagactgtgtctttggcactgattcactcagattgtctgggaaaagactaaaggaacaggaagaaatcagtagcaaaaatcctgctagatcaccagtaactgaaataagaactcaccttttaagtcttaaatctgaacttccagattctccagaaccagttacagaaattaatgaagacagtgtattaattccaccaactgcccaaccagaaaaaggtgttgatacattcctaagaagacctaatttcaccagggcgactacagttcctttacagactctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatatttcatgttctctaaatgaactcacctacaataacttaccagcaaatgaaaaccaaaacttaaaagaacaaaatcaaacagagaaatctttaaaatctcccagtgacactcttgatggcaggaatgaaaatcttcaggaaagtgagattctaagtcaacctaagagtcttagcctggaagcaacctctcctctttctgcagaaaaacattcttgcacagtgcctgaaggccttctgtttcctgcagaatattatgttagaacaacacgaagcatgtccaattgccagaggaaagtagccgtggaggctgtcattcagagtcatttggatgtcaagaaaaaagggtttaaaaataaaaataaggatgcaagtaaaaatttaaacctttccaatgaggaaactgaccaaagtgaaattaggatgtctggcacatgcacaggacaaccaagttcaagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaagggaagaaaagtcgtcatcaaaaagaggattccctttcttggagtaatagtgcttatttatccttggatgatgatgctttcacggctccatttcatagggatggaatgctgagtttaaagcaactactgtcttttctcagtatcacagactttcagttacctgatgaagactttggacctcttaagcttgaaaaagtgaagtcctgctcagaaaaaccagtggagccctttgagtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacagactgaaacagcagagcttcctgcttctgatagcataaacccaggcaacctacaattggtttcagagttaaagaatccttcaggttcctgttccgtagatgtgagtgccatgttttgggaaagagccggttgtaaagagccatgtatcataactgcttgcgaagatgtagtttctctttggaaagctctggatgcttggcagtgggaaaaactttatacctggcacttcgcagaggttccagtattacagatagttccagtgcctgatgtgtataatctcgtgtgtgtagctttgggaaatttggaaatcagagagatcagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggaggaggcaaagaaaaccaatttttgatgccccctgaggagactatactaacttttgctgaggtccaagggatgcaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcctcccacctgtctctgaccaacattggtcttttgtgaaatggtcgggtacagactctcatttgctggctggacaaaaagatggaaatatatttgtataccactattcataagttagggtaaagtgaaaacacaattttctggatatattgggcctcttagtattttttggagttttaaatataaaggagaatatctgaatgacacttaaaatgattgcttgtttatgtccagacagacttattttttattctaatgatggtagcaccactgatcttggatgtacatttatgtatactttgagaaaaagggttttaggttgatttttgtaatttcccacatttgtacatgtgcttttaaaggtgtacataaagcttcaaatggcaataaatatttattttt

SEQ ID NO: 64 - DNA, 3958 bp, Homo sapiens
  >PARP1|ENSG00000143799|ENST00000366794|3958
cggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaaacaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 65 - DNA, 1886 bp, Homo sapiens
  >PARP2|ENSG00000129484|ENST00000250416|1886
ggttgatgacgtcagcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 66 - DNA, 2336 bp, Homo sapiens
  >PARP3|ENSG00000041880|ENST00000398755|2336
ggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttggccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccactggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctccttt

SEQ ID NO: 67 - DNA, 5474 bp, Homo sapiens
  >PARP4|ENSG00000102699|ENST00000381989|5474
cgcccgcccagccccgggggcagggagagcctagattacggaagtaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagggaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcgcaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcgccttgcatgcgctgtccttggtgggtgagaagcagaaagtaaatattatccagttcggcacaggttacaaggagctattttcgtatcctaagcatatcacaagcaataccatggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgtgcccgaggccctgcaggccccagcccaggtgccgtccttgtttctcaatgatcgactccttgtctatggattcattcctcactgcacacaggcaactctgtgtgcactaattcaagagaaagaatttcgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttcccccgactgcccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttcttcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttcctctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcctgtgctttctggaagtaaaagaagaggatgaaatagtgtgcatacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacgcttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaatatttca

SEQ ID NO: 68 - DNA, 1359 bp, Homo sapiens
  >PCNA|ENSG00000132646|ENST00000379160|1359
ccgcggatggccggagctggcgccctggttctggaggtaaccggttactgagggcgagaagcgccacccggaggctctagcctgacaaatgcttgctgacctgggccagagctcttcccttacgcaagtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 69 - DNA, 9093 bp, Homo sapiens
  >PIK3CA|ENSG00000121879|ENST00000263967|9093
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaactatcattaatatatattctttatttacatgatctgtcccatagtcatgcattgttttgcaccccaaattttttattgttcatagcagcatggtcagctttcttcttgatctatagatgaggctcaggcactatcccatttataccaataaccagtgtataactacttaaggaaaacataaaaacttcatcttctttccttttatttcttatgtgaatctcccgtcttccattctcttttataattgagaatgtctcaatcatatgaaattagttaccagaattaacacaatttagactatcttcctgattccttaaacccctttactgaagtatactcatgaataatactttaaaatatgggggaatagaaaccatgaactttttacctttttaaactatttatccatatctccaaagtagaacattaaaccattttaagatatgtctcattcccaagtagtcagagctcactctccaactttattaaatactatttgagcacaggacacattcttaaacattttgaaaaacattaacccaagatgtagaggctactgctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataattattggaaatttaggtatttcactaaagcatgtatataatattgccaacaagaaaagtaaatttgaagattaagggaacttacttctgcaaactgtcttgcgatagttaagcagaatttaaactctgttttaagcaggaaaccagaaagattattttgcagttgtagaagatttcataacttattaaaacttattaacattttgtgttgtttagatataggcagttgatacatactaacatcccagccttttcaatatcagggttaaattataggaaaactcagtaaaatggtacaaatctgaaagtttgatggtagaaactgaagatttaacagagaactgtgttttacccgagtgccaaaaatgctgtgagcctccttgcacaaaatttataccacttttgcatttttatctatcagtccagatagttgtctcccctccttctcccaggacctctccaccattaaaatgcacaaaccacatggccgatttcaccatttacatttattttcaaaagttactacaaccaaattaattctattagaagaaatgtagacaaattctataaagactatagattgtgacctaagaaagaaatgaggcaaagaaccaaacattgaattaaatgctacatgggtgactaagatctgtttcaagtcagtgataatatagccacttctgggtacttcagtatcagagatcagttctcgtggtttagacagttcctatctatagctgactatccttgtccttgaatatggtgtaactgactattggctctacagttttattgggccacttaagaaatatttccttgaataattattttgagaaaaagtctaaaagtaataaaaataattttaaacacactgtagtaagaaatgactgttggaaaattatgctttcactttctaccatattctcagctatacaaaaccatttattttgaagatttttagactactgttaatttgaaatctgttactcttattgtggaatttgtttttttaaaaaagatgtttctaattggatttttaaaagaagaatggaatttggttgctattttacaatagaacctaagctttttgtggttcttagtgtcctatgtaaaacttagtgtcaaagtaatcaactttgagattttcccttctattctgctttatattaaaagcccattagaaaatgggaacctggtgaatatataatgaattgtaaaatattttaatgtgtaactttttcaactgtgaaactgacttgattttttgatgaaaacagctgctgataaagtattttgtgtaaagtgtagttcttattaatcaggaaaatgatgacttgattagactgtatatgccctcttggattttattttaaatggattggtgactttcacataggtaaaacacagtccatctgtattcttttttccatcaaaaatcgagtgatttggaattataaaaaaattgtgagcagcctatttgaaaggcatcatggaaatttcacagcacaataacacggatttgttttttcttaatgatgtaaatccgtttaattcatactttgatcaatagcccatgcttgccaactctgaagaaatttaatttccagcagtattttaaagctagcctgttaactttttctgaatatttaaagttcctcttttttctatgtctgcacaaactgcagacctgggctggacccacatactcaagagtccaccttaagaaattattttgatgtccaagacatcactaaaatatttaagtttaaagataatatgtggtgttaatagattgtggtgcttttactatttaaagacaactttcatacttcagatgtttttgagaagaggggaatgtgaggggagggggcagaacagggaggagttgtttgaatgaattacattctttatatccatcctgctcatttggggcatgtctttaagagaaggctgaaagttgtgagagtatattgtataccgtaagagaatcaactcttcatcatggatgggattgtgaaggctgaactataaaattcagcattgacagcatcctcaattaataattcttggtgacagaataatacagctgggctgttttttaaaatataaacaataccatttttaattattacattaaaaattgtaaatatatctatgtgccatggcctgggaagcctgctttcttttttcataaaaattatttttactgtatgaaaagatcatggggtttagctcaaaatatctgtggtcctgataaaattggattggtaactctacctcagaaggaaaatgggaaaaaaaaatagatgagtcacaattcaatacttcaagctcagaaactgtgcagatcactgaattttagatttataaagtcagagttggcatgccttgtttttaatgatatggaagaccttaagaaaaaaacttggctgaagtttaatcgttggtccagccatttgaaaaaggcaatagtttgaggaggttcccgaattcggcatttgaaattcattttgttctctcttcttcattattagtgcatttggtgtgtgtatacttgcacacaattctgtttgtgtacacactgcttgcttagccctagtcaagaggcatcttttataaaaggtgtaaagaaatatcaaggttctaaaattcggaagagtttagaatttattaggagtttcccaagttgggatgttagtctttaaataaacttcatgcacctattccacttaaggttttgcacctcctttttattagtgcagtgccatttcttctgcttgattttaggtatgttaatattccagccttgctagttagcataaagtgacaggtgtgagccatgaggaaattttctgacttaatttgtacacaactacatataagagttttagtggaggaaaaaaattagtcccttgtgcgtatacagtagttaggtaaatgatttttctaccaacagtatactccattcctcatgtaggtaagtacagaaaaggtttttaaatgtatttttttagccagttaaagtctatgaatctatctgcaaccttatttaatctgtcactataataattttgtggttatgctaagaaccatgtatacttttaggtattcttatttttgtcaatttttctaggttggcaaggaggcagaaaaccttcattgtttcatattaaaatataattagactaaacttaattctagtatgaatttccaaaatcattatctatttatttcatttttatttaattttgtttttatttcatttttaaaagtcccttgttcaatttaacttatgttcctaagagaggttggagaacttggccttcatctgatttcaaaaatgttttgagtttcaaatgaagttaatggtttcagtgtgattcagtcctcagacctaattgggttgaataaaatctaaaagaatatacccttttggagcataacattttaataccttggggaatgtggcactaccaaaagaagactactaacacgtcagatgttcacctggaagctttatcaagaaattcgaaccacccttttggccccattaattgtagcaagtttatttctctatattttgtcattcagtgaattgaagtcctgtggtatactgcattcattagaagaaaaacgtttttaatgtccttttaatgatggcccagaaagcatttgacacagcaagatgcatgtgttactatattgagaatatagaataataacagtatcactaaatttaagacctcttcccagtcttgctgttcctagcaagaagtttggcctgtgactgcacttactgtttatgctcatcagaaactgtcaatgtctgcttttctttaactctgcagtctgtaacatcacgctgtttattaaaaaaaaaaagaaaaatta

SEQ ID NO: 70 - DNA, 2855 bp, Homo sapiens
  >PMS2|ENSG00000122512|ENST00000265849|2855
ggagcacaacgtcgaaagcagccaatgggagttcaggaggcggagcgcctgtgggagccctggagggaactttcccagtccccgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttccgatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctaaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaacctgctacttaaaaaaaatacacatcacacccatttaaaagtgatcttgagaaccttttcaaaccaga

SEQ ID NO: 71 - DNA, 5440 bp, Homo sapiens
  >POLA1|ENSG00000101868|ENST00000379059|5440
gggagattcgggaccatggcacctgtgcacggcgacgactctctgtcagattcagggagttttgtatcttctcgagcccggcgagaaaaaaaatcaaagaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgctgatgagaaaggaaaagatggtaaagcacgcaataaagacaagaggaatgtaaagaagctcgcagtgacaaaaccgaacaacattaagtcaatgttcattgcttgtgctggaaagaaaactgcagataaagctgtagacttgtccaaggatggtctgctaggtgacattctacaggatcttaacactgagacacctcaaataactccaccacctgtaatgatactgaagaagaaaagatccattggagcttcaccgaatcctttctctgtgcacaccgccacggcagttccttcaggaaaaattgcttcccctgtctccagaaaggagcctccattaactcctgttcctcttaaacgtgctgaatttgctggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtgtggtatttctgtttgggaaagtttggattgaatcagccgagacccatgtgagctgttgtgtcatggtgaaaaatatcgagcgaacgctttacttccttccccgtgaaatgaaaattgatctaaatacggggaaagaaacaggaactccaatttcaatgaaggatgtttatgaggaatttgatgagaaaatagcaacaaaatataaaattatgaagttcaagtctaagccagtggaaaagaactatgcttttgagatacctgatgttccagaaaaatctgagtacttggaagttaaatactcggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgagattattgctatggcagctttggtccatcacagttttgcattggataaagcagccccaaagcctccctttcagtcacacttctgtgttgtgtctaaaccaaaggactgtatttttccatatgctttcaaagaagtcattgagaaaaagaatgtgaaggttgaggttgctgcaacagaaagaacactgctaggttttttccttgcaaaagttcacaaaattgatcctgatatcattgtgggtcataatatttatgggtttgaactggaagtactactgcagagaattaatgtgtgcaaagctcctcactggtccaagataggtcgactgaagcgatccaacatgccaaagcttgggggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacagtgaatcttctcaactgttatacctgttggaacacacctggaaagatgccaagttcattttgcagatcatgtgtgagctaaatgttcttccattagcattgcagatcactaacatcgctgggaacattatgtccaggacgctgatgggtggacgatccgagcgtaacgagttcttgttgcttcatgcattttacgaaaacaactatattgtgcctgacaagcagattttcagaaagcctcagcaaaaactgggagatgaagatgaagaaattgatggagataccaataaatacaagaaaggacgtaagaaagcagcttatgctggaggcttggttttggaccccaaagttggtttttatgataagttcattttgcttctggacttcaacagtctatatccttccatcattcaggaatttaacatttgttttacaacagtacaaagagttgcttcagaggcacagaaagttacagaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcagtatgacattcgacagaaggctttgaagctcacagcgaacagtatgtatggttgcctgggattttcctatagcagattttacgccaaaccactggctgccttggtgacatacaaaggaagggagattttgatgcatacgaaagagatggtacaaaagatgaatcttgaagttatttatggagatacagattcaattatgataaacaccaatagcaccaatctggaagaagtatttaagttgggaaacaaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaactttgtgattggccagattctttctgatcaaagccgggacactatagtggaaaacattcagaagaggctgatagaaattggagaaaatgtgctaaatggcagtgtcccagtgagccagtttgaaattaacaaggcattgacaaaggatccccaggattaccctgataaaaaaagcctacctcatgtacatgttgccctctggataaattctcaaggaggcagaaaggtgaaagctggagatactgtgtcatatgtcatctgtcaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcgggaacagatatggagcccagcttgtatcgttgcagtaacatcgattgtaaggcttcacctctgacctttacagtacaactgagcaacaaattgatcatggacattagacgtttcattaaaaagtactatgatggctggttgatatgtgaagagccaacctgtcgcaatcgaactcgtcaccttccccttcaattctcccgaactgggcctctttgcccagcctgcatgaaagctacacttcaaccagagtattctgacaagtccctgtacacccagctgtgcttttaccggtacatttttgatgcggagtgtgcactggagaaacttactaccgatcatgagaaagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaaa

SEQ ID NO: 72 - DNA, 1329 bp, Homo sapiens
  >POLB|ENSG00000070501|ENST00000265421|1329
aacaagcgccgtgcgccccgccccccatcgggggcaaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactatta

SEQ ID NO: 73 - DNA, 3540 bp, Homo sapiens
  >POLH|ENSG00000170734|ENST00000372236|3540
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaa

SEQ ID NO: 74 - DNA, 2792 bp, Homo sapiens
  >POLL|ENSG00000166169|ENST00000370162|2792
tgactcggaagctattctggccatttgccctccttccccccttcgtccgctctcattggctctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattg

SEQ ID NO: 75 - DNA, 3253 bp, Homo sapiens
  >POLN|ENSG00000130997|ENST00000511885|3253
agtgcgaggcgcgcggggcacggagggcggtggcggcgggctcctgcgagaagcaagcggaacttcctgagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggattttgtgaaaatggaaaattatgaggcattggtaggctttgatctctgtaatacaccgctctccagtgttgctcagaagattatgtctgctatgcattcaggtgatttagtggattctaagacttggggaaagagtacagagactatggaagtgataaacaagtccagtgttaagtattcagtacaacttgaagacaggaagactcaatcaccagaaaaaaaggatcttaaatctttaagaagtcagacatcaagaggttctgccaagctgtctcctcagtccttcagtgtcaggctcacagatcagctgtctgctgaccaaaaacagaagagcatcagctcattgactctttcaagttgtttaattccacagtataatcaagaggcttcagttctacagaaaaaggggcataaaagaaagcatttcctaatggagaatataaataatgaaaataaaggaagcattaatcttaaaagaaaacatattacatataataatttgtcagagaaaacaagtaaacaaatggcattggaagaagatactgatgacgccgaaggctacctaaattctgggaactcaggagcattgaaaaaacatttttgtgatattaggcatttggatgattgggcaaaaagccagctgattgaaatgctcaaacaggcagcagccctggtgataactgtgatgtatactgatggttccacccagctaggagctgaccagacccccgtttcttctgttagaggaattgtggtgttagtaaaacgccaagcagagggtggccatggctgtccagatgccccggcctgtggtcctgttctggagggctttgtgtcagatgatccatgcatctacattcaaatagagcactctgctatctgggaccaagaacaggaggcacatcaacaatttgcccggaacgtgctatttcaaacaatgaaatgtaaatgtcctgttatttgttttaatgctaaggattttgtgagaatagtgctgcagttttttggcaatgatggcagttggaagcatgttgctgattttatagggctagatcccagaattgctgcatggcttatagatcctagtgatgccacaccctcttttgaagatttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcagtgttaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccaggctggtggcccagatccatgatgagctgctgtttgaagtggaagatccgcagatcccggagtgtgcagctctcgtcaggaggaccatggagtccttggaacaggtgcaggcattggagctgcagcttcaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttgtctgagtgaattcttcctgtgagtgggaagtg

SEQ ID NO: 76 - DNA, 8775 bp, Homo sapiens
  >POLQ|ENSG00000051341|ENST00000264233|8775
gggcgggccgggaggtttgagtttgaagactggcgggaagatgtccgcagctgttgccaggccagggttctcccgagagggaggacgctgggactgtggcttgccctgatcggccgagaagagtttgccatgaatcttctgcgtcggagtgggaaacggcggcgttcagaatcaggctcagattcgttctcgggaagcggcggtgacagcagtgccagcccccagttcctctccgggtccgtgctgagcccgccgcccggccttggtcgctgcctgaaggccgcagctgcaggagaatgcaagcctacagttcctgactacgaaagagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcagctcctacaagtgctgggaagactcttgtggcagaattacttattttgaagcgggttttggaaatgcggaagaaagctttgtttattcttccctttgtttctgtggctaaagagaagaaatactacctccagagtctgtttcaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttggcatgagtgctacccttcctaatttggagcttgtggcttcctggttgaatgctgaactctaccataccgactttcgccctgtaccgcttttggagtcagtaaaagttggaaattccatatatgactcttcaatgaaacttgtgagggaatttgagcccatgctacaagtgaagggagatgaggaccatgttgttagtttatgttatgagacgatttgtgataaccattcagtattacttttttgtccatcaaagaaatggtgtgagaagctggcagatatcattgctcgagagttttataatctacatcatcaagctgagggattggtgaaaccctctgaatgcccaccagtaattctggaacaaaaagaactcctggaagtgatggatcagttaagacgtttgccttcaggactggactctgtattacagaaaactgtaccatggggagtagcatttcatcatgcaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggccgtgctggcaggaaaggagtggacacagtaggcgagagtatcttaatttgtaagaactctgagaaatcaaaaggcatagctctccttcagggttctctaaagcctgttcgcagctgtctgcaaagacgagaaggagaagaagtaactggcagcatgatacgagctattctggagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtttttcaccagtcttgtgctattagatttaatcagtgaagttcccttaagggaaataaatcagaaatatggatgcaatcgtgggcagattcaatctttgcaacagtcagctgctgtttatgcagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgcagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccaaacaggattgtcacgaaagagaaaactgcaagggatgttctgcccaatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaa

SEQ ID NO: 77 - DNA, 13506 bp, Homo sapiens
  >PRKDC|ENSG00000253729|ENST00000314191|13506
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 78 - DNA, 9027 bp, Homo sapiens
  >PTEN|ENSG00000171862|ENST00000371953|9027
ggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgttgctgcaaaagccgcagcaagtgcagctgcaggctggcggctgggaaccggcccgagcaagccccaggcagctacactgggcatgctcagtagagcctgcggcttggggactctgcgctcgcacccagagctaccgctctgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggctggcacatccagggacccgggccggttttaaacctcccgtgcgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactatactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagacccttaaatctagttaatttgctgctaacatgaaactctttggttcttttatttttgccagataattagacacacatctaaagcttagtcttaaatggcttaagtgtagctattgattagtgctgttgctagttcagaaagaaatgtttgtgaatggaaacaagaatattcagtccaaactgttgtaaggacagtacctgaaaaccaggaaacaggataatggaaaaagtcttttaaagatgaaatgttggagccaactttcttatagaattaattgtatgtggctatagaaagcctaatgattgttgcttatttttgagagcatattattcttttatgaccataatcttgctgtttttccatcttccaaaagatcttccttctaatatgtatatcagaatgtgggtagccagtcagacaaattcatattggttggtagctttaaaaagtttgtaatgtgaagacaggaaaggacaaaatagtttgctttggtggtagtactctggttgttaagctaggtattttgagactacttccccatcacaacaacaataaaataatcactcataatcctatcacctggagacatagccatcgttaatatgttagtgactatacaatcatgttttcttctgtatatccatgtatattctttaaaaatgaaatttatactgtacctgatctcaaagctttttagcttagtatatctgtcatgaatttgtaggatgttccattgcatcagaaaacggacagtgatttgattactttctaatgccacagatgcagattacatgtagttattgagaatcctttcgaattcagtggcttaatcatgaatgtctaaatattgttgacattaggatgatacatgtaaattaaagttacatttgtttagcatagacaagcttaacattgtagatgtttctcttcaaaaatcatcttaaacatttgcatttggaattgtgttaaatagaatgtgtgaaacactgtattagtaaacttcatcacctttctacttccttatagtttgaacttttcagtttttgtagttcccaaacagttgctcaatttagagcaaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatatttttaaatcaagtgtttaacaagaatttatattttttattttttaaaattaaaaataatttatatttcctctgttgcatgaggattctcatctgtgcttataatggttagagattttatttgtgtggaatgaagtgaggcttgtagtcatggttctagtgtttcagtttgccaagtctgtttactgcagtgaaattcatcaaatgtttcagtgtggttttctgtagcctatcatttactggctatttttttatgtacacctttaggattttctgcctactctatccagttgtccaaatgatatcctacattttacaaatgccctttcagtttctattttctttttccattaaattgccctcatgtcctaatgtgcagtttgtaagtgtgtgtgtgtgtgtctgtgtgtgtgtgaatttgattttcaagagtgctagacttccaatttgagagattaaataatttaattcaggcaaacatttttcattggaatttcacagttcattgtaatgaaaatgttaatcctggatgacctttgacatacagtaatgaatcttggatattaatgaatttgttagtagcatcttgatgtgtgttttaatgagttattttcaaagttgtgcattaaaccaaagttggcatactggaagtgtttatatcaagttccatttggctactgatggacaaaaaatagaaatgccttcctatggagagtatttttcctttaaaaaattaaaaaggttaattattttgacta

SEQ ID NO: 79 - DNA, 3233 bp, Homo sapiens
  >RAD17|ENSG00000152942|ENST00000509734|3233
ccccgggaggccgtacctccgagaggctcggcgttgagcccgggtagggccaggtggctgccctttcacctagggtagtccctggtcgcctccgctcttcgcctaaaaggggatgcagctccgggaaagtaaggccgccgcggttgcggctatattatgtatatgtcttagagacgtgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 80 - DNA, 5886 bp, Homo sapiens
  >RAD18|ENSG00000070950|ENST00000264926|5886
cccgcctctggcgcgtcgcgggctgctgacgtaatgcggtagcgcggggaatttcgagtggtgttggagcgccggaggctagtgggtggctgacccccagcatcctcgggagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcgagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcacaaaaggattctttcaacttctttattgcaagaaacagttgagttaaatgtttgtttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccaacccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgagggagcggtgagacccaagattgggaaagtaggcacatgagttcattcagcaaatatttggttatctatgtctgtcactgtgctgacactgggaatacaaaggtggccaaagatcatctagaacaatggttcccagtggggtgggcagaaagattttgccccccaggagacagctggcaatgtgtggagacacttttggaggtggagggtggtgaggggtactaccagtatcaatgggtggaggccagggatgaggctaaacacccaaccctcatggattagtttgccagggctgccgtcacaagatactgcagacggggaagcttacacaacagaaatgtgtattctcagaattctggaggctggaagtccaagatcagtagggtttcttcttcggcctctctccttggcttccactcatggtgtccttgcatggtcttttctctgtgtgcacatgactgtgcaggactggtgtcccgatttcttgtagggacagcagtcattggatcagggcccatgcgtatggcctcattttacttcagttacctcttttttagatagagggccctatctctaaatactgtcacattctgagataccggcagttaagacttccaacatatttagtggtaggggttaaggggcacgctttagactacaacactccacagtaaagaattatccagtctaacatgtcagttgtgccaagactgagaaacctgtaatgtaaaggaactcccaagtctacctgaaaagtaaggtctaaagagcatttattgagcactatctgttagcacttagcatatgtttaatattcatacattgaaagaaatgtatgttcatatccatctgacaaagattaaggaacttagagtaagtaatagatccaaaattgaaactgataaacttctggttctaaaattcaccttttagtgaaaatacagtttctcaccaaacttacagtaattcagagttattaactctttctacctcctcactcccctcaaagttataacatctcccatcaacatcagctcagaatggcagtgatgcttatggtttgtgggggtgcaggtgagctgctggatgcactttagatggcctagtatgccaggccgtcctttcatcctctactctcgtctttctttttcgacctcatgttgaggattactggtctagttgaaaaaagaattcatacacataagaccatgtatataatagagggaggtatgcctttaaaaacaaaattacatggtaaagactgatgtgtcaacagggatagacaacatagagaaggctagaactgtttctggaaaaaaacccaaaaacaatggatttcaaacttcttagcatccgataaaagaaagtagcaattattcaaatgagaaacacttctgtctgttatgtacatattatgaaagtatgaacataagagggaaaaccacaaccattacattttttaccatttcagtaatttttttttggtttttagtctgtttttagacatccttaagaacaactatctgaggctgtaaacaagtatttacattaacacccatgatactgactttatactccctacctgcattgagaccttaaagggggcatttctccattccttctgtgtatttctgggtatccccaggttcagatattcagaatacagatacaagtccatgcttgcatatgttgctgctccccccgacagacttctaccagcatctgccctcctcaccgctgctctgtcacgtgcactgcggctggccctgctggaaagtcctaccttgcctaggacgccatccccgatatagccccaagatgcaaacctgccaagtgctagggcagccctgccttcctgtccatttcagtctcttggccttgctgtgttccaagtggaaatgggagtgtgctttcctggtttgctagtgtactatcacccggaccacagcgtcctgtgcaaaaatttgcttcctctctcttcccctttcactctttctcttttctcttccccacccccttttttttctctttccccttacctttctttcctttccactcttcctgtccttccttccttcaactattaggactatatgtcaagtaatgtgcaaaacaaagacagttcctgccctgatggagcttgtagatcagaagggaagatgagcattaagtaattatatagattaatgtacaactgtgatgagtgcaacaaaagagaggttcatggcactatcaaacatgcaatggacggattttgtttttgcctataaactcttgccatagaaagcttgaaaatcagtccagggggacagcattaatcaccatgttctttccttatccctgtcttccccaaaattcatgtgttgaaacttaacaagaggtgggaactttaggatgtgattaagtcgtgagggcacagctcttatagatggggtcacggtccttctaaaagggcttgagggagtggttttgtttccttccatcccttccgccacatgaggacacagtcttcgttccctctggaggactcagcaacaacacaccatcttggaagcagagagcagtcctcaccagacacggaatctgccagtgccttgatcttggacttaccagcctccatacctgtgagaaataaatttctattgtctataagttacccagactgtggtattttcttctggcagcacaaatggacacccagaaactgatgcatgcatcttctgactcctttgattccaaaatacaaaatattagaataaagttatggaagtc

SEQ ID NO: 81 - DNA, 6022 bp, Homo sapiens
  >RAD50|ENSG00000113522|ENST00000265335|6022
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaa

SEQ ID NO: 82 - DNA, 1588 bp, Homo sapiens
  >RAD51|ENSG00000051180|ENST00000382643|1588
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagctaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctgacggagtctcgctctgttgccaggctggagtgcaatagcgtgatcttggtctactgcaccctccgcctctcaggttcaagtgattctcctgcctcagcctcccgagtagttgggactacaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaaggg

SEQ ID NO: 83 - DNA, 2710 bp, Homo sapiens
  >RAD52|ENSG00000002016|ENST00000358495|2710
ttcccagagacgctcgcgcacccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttc

SEQ ID NO: 84 - DNA, 3068 bp, Homo sapiens
  >RAD54B|ENSG00000197275|ENST00000336148|3068
gattggcttcgccgaggcgggatccttgagcttctccggcggcgaggggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcattgta

SEQ ID NO: 85 - DNA, 3108 bp, Homo sapiens
  >RAD54L|ENSG00000085999|ENST00000371975|3108
ggtcttggcgggtcggtgagtcttggcggctgttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcaataatgtagcagccccctctacagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggt

SEQ ID NO: 86 - DNA, 2119 bp, Homo sapiens
  >RAD9A|ENSG00000172613|ENST00000307980|2119
gggccggcaggggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 87 - DNA, 4840 bp, Homo sapiens
  >RB1|ENSG00000139687|ENST00000267163|4840
tccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaatggtctgatgttgtgttctttgtattaagtacactaatgttctcttttctgtctaggagaagatagatagaagataactctcctagtatctcatcc

SEQ ID NO: 88 - DNA, 10789 bp, Homo sapiens
  >REV3L|ENSG00000009413|ENST00000358835|10789
cgagatctgcgcctcgcctccctcctcacgcgggcggattttcttaccttgtgaaaaaccgtctcagcggctgcccccgcctcctctgctggatgtgaaatggcggtcggcgagtggttgcgtccgtgacatcatcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaa

SEQ ID NO: 89 - DNA, 4340 bp, Homo sapiens
  >RPA1|ENSG00000132383|ENST00000254719|4340
cgggagcggtgcgcgcaacttctcgggccaataactgcgcagcgcgcgggacccgggtggggaagctggagctgttgcggggtccgcggggaagtcttggcggtggagccatggtcggccaactgagcgagggggccattgcggccatcatgcagaagggggatacaaacataaagcccatcctccaagtcatcaacatccgtcccattactacggggaatagtccgccgcgttatcgactgctcatgagtgatggattgaacactctatcctctttcatgttggcgacacagttgaaccctctcgtggaggaagaacaattgtccagcaactgtgtatgccagattcacagatttattgtgaacactctgaaagacggaaggagagtagttatcttgatggaattagaagttttgaagtcagctgaagcagttggagtgaagattggcaatccagtgccctataatgaaggactcgggcagccgcaagtagctcctccagcgccagcagccagcccagcagcaagcagcaggccccagccgcagaatggaagctcgggaatgggttctactgtttctaaggcttatggtgcttcaaagacatttggaaaagctgcaggtcccagcctgtcacacacttctgggggaacacagtccaaagtggtgcccattgccagcctcactccttaccagtccaagtggaccatttgtgctcgtgttaccaacaaaagtcagatccgtacctggagcaactcccgaggggaagggaagcttttctccctagaactggttgacgaaagtggtgaaatccgagctacagctttcaatgagcaagtggacaagttctttcctcttattgaagtgaacaaggtgtattatttctcgaaaggcaccctgaagattgctaacaagcagttcacagctgttaaaaatgactacgagatgaccttcaataacgagacttccgtcatgccctgtgaggacgaccatcatttacctacggttcagtttgatttcacggggattgatgacctcgagaacaagtcgaaagactcacttgtagacatcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctgtcttcaagcactatcattgcgaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgggccaaggcgacaagccggactactttagttctgtggccacagtggtgtatcttcgcaaagagaactgcatgtaccaagcctgcccgactcaggactgcaataagaaagtgattgatcaacagaatggattgtaccgctgtgagaagtgcgacaccgaatttcccaatttcaagtaccgcatgatcctgtcagtaaatattgcagattttcaagagaatcagtgggtgacttgtttccaggagtctgctgaagctatccttggacaaaatgctgcttatcttggggaattaaaagacaagaatgaacaggcatttgaagaagttttccagaatgccaacttccgatctttcatattcagagtcagggtcaaagtggagacctacaacgacgagtctcgaattaaggccactgtgatggacgtgaagcccgtggactacagagagtatggccgaaggctggtcatgagcatcaggagaagtgcattgatgtgagaggagcagtgccaatcgggcagaagtttgcaaataggcagaatggaatcgatttcctcccacctccgtgtgacgatcccatgttagctacacagtgcagaggctcttgatggtggactaagcaatttcccccctcgtgcgcatctcagaacccatcggtaggcaaaggaaaatacgctcaggtggttgtggtgtagactgtgtcaggcctacggagtcagccagtggctagcgcaagaccagtcactccctctgccttcaggcttctgtcaatttcattatcatcaagcaggaattatgtcgtaagtcactgaccctaactgcagaccatgaagtaaattatgtaactaggtttttgcttctccagtggtgaccacccccccccatccccgctcacaacttgggttcttctcagcggggcgagctgagaagcggtcatgagcacctggggattttagtaagtgtgtcttcctagaattcgaaggctctctctttctagaggtgctacatagttggtaatgcttggaatggcaatagggtagaatgattaatcaaaggcatatcttctatatctgaagagtatccttccttcagggtttaatagactgagtcagatgggtctgatattaatcaaaattgtctcttctgaggaccgctgataagcattgacttgccgtcccctaaggaaatccgagcggctacaaagcgtttctttacttctcacttcaattaatgctgcgcttcgcttggtgagtgcgtactttttctacctgtacacattcctgcattcatgtattttgttttttttgactaaagctatgttacatggaaaggattttgaagccttttgtttcccttgctttgttttaataaacagtatattctttggttgtgaatcctactttctttgaatgcaaagagttcctataactggaaagcaattaattagccttcataataaatgttcacttgggggggatgttaactcattataaacccgaagattagtccaaggcatggagatccttcttcctagtgtttgcagccctgaaatgcatctttcaaagcatgaaaacactaaaaacaaaaagccattttgcctgaggatgctgatgatctggcacttgggattttattgatgtttacgcagcagtctaacaccaaccacgctttgaaatgtgtacagacagtgagctggtaagaaaacagtaattatgctagtgggcctttcagtcagcaaaagcatgctcgctctgtgtgttcctaatcatattaattatctatccggtggctgcaacacaccgcctgccattggccgcacatctcgccgtcgtaccccggcagtgcggcggtcactctgcagccagaggacctgctgttcatcactgcacatgccgcctgcggaggcttttggatatggggagtgatggtgtcctgtctgtctcccccctcggtgtctgccgttgacataggggccagccagccctagacgggatgacttccgttcctgaggacagacacagagggactcctgctcagcctcactaattgtttagacacattccttcctacccttctctagtctcaggagatggtaactgggtcgcatttcagtctctgactgaggcctcagccatttttacggaagttcttttctgtctgaccttgcttataaagcatcgacgagaaaattacagtcttcaaccctcttctggattgacaaattgtggctgggaagtggcgatctagctttcagcccagtaaccagtctttcatgcctactactcccagcattccctcctctccccacgtgtctgtccacacagtgaagaggcctgaccagccgtggtaccaggacaggacgtgtccagggaacgctgacacctgtcctcgcgccttctcagtggccagcgtgatgaaaccagcacgtctccgtggatgtgattgggaacccaggggcagtgccagggggagggctccctcgaggaggctgtttctaacagatttccccactcaaagatcagatcaccagcagaggagcatcagaaactggctccactgttgggcttttcagagattttggtccctgcgggttgcctaaatagattctggcccacagtttacctcgaaaggctgttgatgttgttctgtttctcctctttcacttagagatcaatgttgattttgcgtacaccatgacatcagcgttaggcaattaggagaaaaaaatctaatcatttcgcctttatttcaagtggttcttgaattccctccagtctcattgtgaaaggggcagggaaaaaaataaaagggtaataatctgatttctgtccatatttccagtgttttatgctttccattaaaaccttgctaatctct

SEQ ID NO: 90 - DNA, 1752 bp, Homo sapiens
  >RPA2|ENSG00000117748|ENST00000373912|1752
agtgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaa

SEQ ID NO: 91 - DNA, 7307 bp, Homo sapiens
  >SLX4|ENSG00000188827|ENST00000294008|7307
gcgagtctccgttaagaaggtgccgcggcggcgccggagatgtgtaattaagtgaaccatatatgtttcatcatcatggagatcttggagaattatctgagcaccaggttcatatgtattcgatctcagaggcatctattggacaacaaaacactctttcagttgtgaactttatttatttattattattattttttgagacagagttttgctcttgttgcccaggttagagtgcagtggcacgatctcggctcactgcaatctccgcctcccaggttcaagcgattctcttgcctctgcctcccgagtagctgggattacaggcatctgctaccacgcctggccaattttttgtattttcagttgaaacgaggtttcaccatattggccaggctggtctcgaacttctgacctcaggtgatccaccccccgcctcgtcctccaaaagagctgggattacaagtgtgagccaccgcgcccggcccagttgtggactttaacagagggaagctttaaacatgtttaaccacaggcccaatttgaacaaagatacttcaatcattatagagaggaaaacagtactttttgttcaattgtgcaaactctccaagtatctaatggagaagtagagaagaaccctaatgaaactgagtgtgaatgaggctcagctaggcttctacttgggttcactttctcatctgtctgcctgtcctgggattgaccctcgctcctctgaagaccagcctgaaagccttaaaactggtcagatgatggatgagtctgatgaggactttaaagaactctgcgctagctttttccaaagggtgaaaaaacatggaatcaaggaagtgtcaggagaaaggaagacacaaaaggctgcctcaaacggcactcagataagaagcaaattgaaaaggaccaaacaaactgctaccaagaccaaaacccttcaaggccctgcagagaagaaacctccgtctggcagccaggcccctaggactaaaaagcaaagggtaaccaaatggcaagcaagtgaaccggcccactctgtgaatggggaggggggtgtgcttgcctctgctccagatccacctgtgctccgggaaacagcacaaaacacccagacgggtaaccagcaagaaccatcgccaaacctttccagagagaaaaccagagagaatgtgcccaacagcgactcccagcctcctccttcctgtttgacaacagcagtgccaagtccctccaaaccccgcacagcacaattggtcctacagcgaatgcagcagttcaagagagcagaccccgagcgtttgagacacgcttcagaagagtgctccctcgaggctgcgcgggaagaaaatgtcccaaaggatcctcaagaggagatgatggcggggaatgtgtatgggcttgggccccctgccccagagagcgacgctgcggtggccttgaccctgcagcaggagtttgcacgggtaggagcatcggcacatgatgatagcctggaggaaaagggtttgttcttctgccagatttgtcaaaagaacctctcagccatgaacgtgacccgaagggaacagcatgtgaacaggtgcttggatgaagctgaaaagacactaagaccttctgtgcctcagatccctgagtgcccgatttgtgggaaaccgtttcttaccttaaagagcagaaccagtcacttgaagcagtgtgctgtgaagatggaggttggcccccagctcctgcttcaggctgtgcggctgcagacagcacagcctgagggtagcagcagcccacccatgttcagcttcagtgatcacagtagaggtctgaaacggagaggacccaccagcaagaaggagccacggaagaggcggaaggtggacgaggcaccgtccgaggacctgctggtggccatggctctgtcccggtcggagatggagccgggtgcggctgtaccagcgctcaggctggaaagtgccttttctgagaggataagaccagaagcagagaataaaagtcgcaagaagaaacccccggtatcccccccattgttgttagtccaggactctgaaaccacaggccgacagatagaggaccgtgtggccctgctcctctctgaggaagtggaattgtctagcacgccaccacttcctgccagcaggattttaaaggaagggtgggaaagagcgggccagtgtcctcctccacctgaacgcaagcagagctttctgtgggagggcagcgcactgactggggcctgggccatggaggacttctacacggccaggctggtccctcctctcgtgccccagcggcctgcccagggccttatgcaggagcccgtgccgcctctggtgccacctgagcactcagagctgagcgagcgaaggtcacccgctctccacggcacccccactgcaggctgtggctccaggggcccgtcgccttcggccagccagagggagcaccaggccctgcaggacctcgtggacctggcgagggagggactgagcgccagcccgtggcccggcagtgggggcctggctggctcggaagggactgcagggttggacgtggtgcccggcggccttcctctgactgggtttgtggtgccatcgcaggacaagcacccggacaggggcggccgcaccttgctctccctcgggctgctggttgctgactttggcgccatggtcaataacccacacctgagtgatgtccagtttcagacggacagcggggaggtgctttacgcccacaagttcgtgctttatgcccgatgcccgctcctcatccagtatgtgaacaatgaaggcttctccgctgtagaggacggggttctgacccagcgtgtcctgctgggtgacgtgagcaccgaggccgcccgcacgttcctgcactatctctacactgcggacactggccttcctcctggccttagctctgagctgagctccctggcccacaggtttggcgtgagtgagctcgttcacctgtgcgaacaggtgcctattgccactgactcagagggcaaaccatgggaggagaaggaagcagagaattgcgaaagcagggccgagaatttccaggaactcttgaggtcaatgtgggcagatgaagaggaggaagcggagactttgttgaaatccaaggaccacgaagaagatcaagaaaacgtgaatgaagcagaaatggaagaaatttatgaatttgcagctactcagcgaaagcttctccaggaagaaagggcagcgggtgccggcgaggacgctgactggctggagggtggcagtccggtttctgggcaactcctagcaggtgtccaggtgcagaaacagtgggacaaggtggaggagatggagccgttggagccaggaagagatgaggccgccaccacctgggagaagatgggacagtgcgctctcccgccaccccagggccagcactcaggggcacggggagcagaggcccctgagcaggaggcgccagaggaggcgcttggccattccagctgctccagcccttccagggactgccaggcagagagaaaagaaggctctcttccgcactcagatgatgccggggattacgaacagctcttctcatcaactcagggagagatctcagagccgtcccaaataacaagtgagcccgaggaacaaagtggcgctgtcagggaaagggggctggaggtttctcatcgcctggctccctggcaggcatctccaccgcacccgtgccgcttcctattggggcctccccagggcgggagtccccgcgggtctcatcacacaagtgggtcgtccctgtcaacaccccggtcccgtggcggaacttcccaggtgggctccccaaccttgctgtctccagctgtgccatcaaagcagaaaagggacaggagcatcctcacgctgtctaaagagccagggcaccagaaaggcaaagagcgtcggtccgtgctggagtgcagaaataagggggtcctgatgttcccagaaaaatctccgtctattgacctaacccagtcaaatcctgaccattcgagctccagatctcagaaatcttcatccaaactgaacgaagaagatgaggtcatcctcttactggactcggatgaggagctggagctagaacaaaccaaaatgaagtccatttctagtgatcctctggaagaaaagaaagctctagaaattagccctaggtcctgtgagctgttttccatcattgatgttgatgcagatcaggaaccttcccagagcccaccaagaagcgaagctgtgctgcagcaggaggatgagggggcgctgccggagaatcggggctctttgggcaggagaggggctccctggctgttctgtgaccgtgagagcagccccagcgaggccagcaccacagacacctcgtggctggtgcccgccaccccgctggccagcagaagccgtgactgttcttcccagacccaaatcagcagcctcaggagcgggctggccgtgcaggcggtgactcagcacacgcccagggcctcagtaggaaacagggaagggaacgaagtcgcacagaagttttctgtcatcaggccccagacaccaccgccccagacaccgtcctcatgcctcactcccgtctctccaggaacttctgacggcagaaggcaaggccacagaagcccttcccgtccccaccccgggggccacccgcactcctctccgctggctccacatcccatctcaggggaccgcgcccacttcagcaggcggttcctgaaacactcgccgcctgggccaagcttcctgaaccagaccccagcgggtgaagtggtggaagtcggagacagtgacgatgagcaggaggtggcctcccatcaggccaacagaagccccccactggacagtgaccccccaattccaattgacgactgctgctggcacatggagcccctctcgccaattcccattgaccactggaacctggagcggaccggccccctgagcaccagcagccccagccgcaggatgaacgaggccgccgacagccgtgactgtcgctccccgggactcctggacaccacccccatccgaggaagctgcactacccagaggaaattgcaagagaagtcctcgggcgcgggctccctggggaatagcaggccgagctttctgaattcggctctgtgggacgtttgggacggggaagagcagaggcctccagagacccctcctccggcccagatgccaagcgctggtggagctcagaagcccgaagggttagagacacccaaaggtgctaatcggaagaagaacttgccccccaaagtgcccataacgccgatgccacagtattccattatggagacgccggtgctgaagaaggaactggataggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacctctgtggatggcagtgacagctccttgagctcacagagttcttcctcctgtgagtttggagcggcatttgagtctgcaggtgaagaggagggcgagggggaggtcagtgcctcgcaggcagccgtgcaggcggcggacacagacgaggcgctgaggtgctacatccgctccaagccggccctgtaccagaaggtgctgctgtaccagccctttgagctgcgggagctgcaggcagagctgaggcagaacggcctccgtgtgtcctcgcgcaggctgttggacttcctggacacccactgtatcaccttcaccactgccgccacccgcagggagaagctccagggcaggaggcggcagcctcggggcaagaagaaggtggagcggaactgatggggccatcccgaccccaccccaacctgccatcagcagcccccacccccgccatttgcagggaggacctgggacacccagcgtgggtcaggcctccacaggcatttctgggcctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgtgtctccctttttggttttctttttttttttctttttgagacagtcgtgctgtgtcacctaggctggagtgcagtggcacaatctcggctcactgcaacctccgcctcccgggttcaagcaattctcctgcctcagcctcccagatagctgggactacaggcacacgctgccacgcccagctgattttttatattttagtagaaacggggtttcaccatgttgctcaggctggtcacaaactccagagctcaggcaatccgcctgctgcggcctcccaaagtgctgggatcacaggcgccagccactgcgcccggcccagtgtgtctcccttaacccaagagggccctcagctgtcccagggggcagtgggccatcaccagctggccagggcatggcctattctgccacatttgccaccctctgagcccaccagtcctgggcacagctgccctacatgtctgtcctgagatggacgtcaggtccagcctgccccggcagcccgggcccgtcctcctcagcactcaggccaaccccagccaccgccagcctgagaccaggtgtcctgaggctccctgcactgccacagcccagatgcagttctcctgacccagccgtgctacccggacacttgtcattgttaccagcagtctccaaactggacagtgcacaagggcccagaacaactctgatgccaccacaaaacaaacatgttcactagcggattccattctttgggttaaagctgcctccagcctcaggagcagtgtggaggaagatgagggccaggaaagaaggaaaccttggtttctccatccttgtgaatgtcctcgtctgtttcaaatacagtgcagtcagttttatatgatgtgcaataaaccaaaaaggctttattaaaa

SEQ ID NO: 92 - DNA, 3696 bp, Homo sapiens
  >TDP1|ENSG00000042088|ENST00000335725|3696
gttggttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagctttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactg

SEQ ID NO: 93 - DNA, 2071 bp, Homo sapiens
  >TDP2|ENSG00000111802|ENST00000378198|2071
gcacccaccgccccggcggctcccttgcggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttta

SEQ ID NO: 94 - DNA, 3240 bp, Homo sapiens
  >TMPRSS2|ENSG00000184012|ENST00000398585|3240
accagggtcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagt

SEQ ID NO: 95 - DNA, 5758 bp, Homo sapiens
  >TOP2A|ENSG00000131747|ENST00000423485|5758
gattggctggtctgcttcgggcgggctaaaggaaggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaacccatagaa

SEQ ID NO: 96 - DNA, 5389 bp, Homo sapiens
  >TOP2B|ENSG00000077097|ENST00000435706|5389
tttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactg

SEQ ID NO: 97 - DNA, 5378 bp, Homo sapiens
  >TOPBP1|ENSG00000163781|ENST00000260810|5378
ggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacataagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttctgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaa

SEQ ID NO: 98 - DNA, 6231 bp, Homo sapiens
  >TP53BP1|ENSG00000067369|ENST00000382044|6231
gtgacgggaaagggggagttcgcggccggtggcggcggtggcgacagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaa

SEQ ID NO: 99 - DNA, 2579 bp, Homo sapiens
  >TP53|ENSG00000141510|ENST00000269305|2579
gttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 100 - DNA, 12677 bp, Homo sapiens
  >TRRAP|ENSG00000196367|ENST00000359863|12677
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccagggtaaaccgacctggtccggcatgcattcatcatcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtt

SEQ ID NO: 101 - DNA, 3671 bp, Homo sapiens
  >UBE2N|ENSG00000177889|ENST00000318066|3671
ggttaagagagacgcgcgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaacaaatgttagcttaattcagaatgaaatagttaacaaccctaatattgtaaaatttgaaaactgatagcagctgtcatttataacaattcttgggctgtttaaagggtacatttgactatagctaaggaaattgaatctcactttaaaaatgaaccacacaaaacttcaagaaacgaaatagaaatcaacatttactgcccgtaatattgctcatggttatagctagtatcacatagtgatttacaaaccatgaaattccagatttaaatctgttgcactacaaaaatgtctaaatgatgtctgctaaatttgtgagttatagaagtacagaaataagtcattttcatttcaaatgcagtgaatttctaatttcatggtatcatatttttttcctttgcagttttggtaagactcccccattactttgctaagacttgctttctcaaccagtgggatgaaacgagtgccagtgtgttgactgagccttcttaggacttaaggggctctgggagaggccaaggcagcagttgaaaactgcagcttcacctggcctttgggcctgttttccctggcccacacagtgtggctggttaaaacattctgaatttgatgccaacatttttaaaaattgggagatttgcatgaaaatccagaattcgggtaacttttgaatgatctgaagatctggcaacagtagacctgacccacctttgtgcacgggacttaactgagaggatctgagtagcagacaccctaagagcatgtcattgtcttctcaccagttactctccagttggctagagtcccctccgagcacacctgctagtccttcccccttgtaagcctttgactttgtaatccctgggctaaaggaaacacattattcaacaaaagtgtttcatgtttgcccactagttgttggggatgattaggtggtgagtgaatggcatggggctttcctttggggaccatatactctaatggggaagggggacagacaaatagttgtaactctgtcatggaaaagagaagtaacttggacagacttttggattcaggccagatgaacatctccaggcagagggaacagcagcatctgcaaagtc

SEQ ID NO: 102 - DNA, 2570 bp, Homo sapiens
  >UIMC1|ENSG00000087206|ENST00000377227|2570
gggctcgggatgcggggctgggaccctcccgattccggggcggattccggacgccgggaccggccattactggtgccgggttgggcttctccagatgccggggctgggtccttcccaaggttgagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatatatttatgtttgtacgaaatcttatttcaatagatggaaattttaat

SEQ ID NO: 103 - DNA, 3996 bp, Homo sapiens
  >USP1|ENSG00000162607|ENST00000339950|3996
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaa

SEQ ID NO: 104 - DNA, 3707 bp, Homo sapiens
  >WDR48|ENSG00000114742|ENST00000302313|3707
aagtgacgtcggagtgtcaacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggc

SEQ ID NO: 105 - DNA, 5215 bp, Homo sapiens
  >WRN|ENSG00000165392|ENST00000298139|5215
ggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcgggttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagttgcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatata

SEQ ID NO: 106 - DNA, 1417 bp, Homo sapiens
  >XPA|ENSG00000136936|ENST00000375128|1417
ggctcgcctcggcgtgcagtgcgcgtgcgtggagctgggagctaggtcctcggagtgggccagagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctga

SEQ ID NO: 107 - DNA, 2802 bp, Homo sapiens
  >XRCC1|ENSG00000073050|ENST00000262887|2802
tcccttggccccaggagacaggggttgcagaaagccgagatcgtgccactgcactccatcctgggtgagagagcaagaccctgtctcaacaaaaaatttttaaaaaataaaataaataataatacagcaaaaagatttgctttctcggcttcagtgtgggcggtaactccatcgtgcaatgagaaaggcgaatttcttccagacaccaatcccggaggtcgcttctgttgctaggctcccagaaagcagggttcggacgtcattgggaggcgaggctagagcggggttgtgtgtggcggagggaggcggggctggaggaaacgctcgttgctaaggaacgcagcgctcttcccgctctggagaggcgcgactgggcttgcgcagtgtcgacgccggcgccggcgcgccggggtttgaaaggcccgagcctcgcgcgcttgcgcactttagccagcgcagggcgcaccccgccccctcccactctccctgcccctcggaccccatactctacctcatccttctggccaggcgaagcccacgacgttgacatgccggagatccgcctccgccatgtcgtgtcctgcagcagccaggactcgactcactgtgcagaaaatcttctcaaggcagacacttaccgaaaatggcgggcagccaaggcaggcgagaagaccatctctgtggtcctacagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaagcgctgggaccgggtcaaaattgtttgcagccagccctacagcaaggactccccctttggcttgagttttgtacggtttcatagccccccagacaaagatgaggcagaggccccgtcccagaaggtgacagtgaccaagcttggccagttccgtgtgaaggaggaggatgagagcgccaactctctgaggccgggggctctcttcttcagccggatcaacaagacatccccagtcacagccagcgacccagcaggacctagctatgcagctgctaccctccaggcttctagtgctgcctcctcagcctctccagtctccagggccataggcagcacctccaagccccaggagtctcccaaagggaagaggaagttggatttgaaccaagaagaaaagaagacccccagcaaaccaccagcccagctgtcgccatctgttcccaagagacctaaattgccagctccaactcgtaccccagccacagccccagtccctgcccgagcacagggggcagtgacaggcaaaccccgaggagaaggcaccgagcccagacgaccccgagctggcccagaggagctggggaagatccttcagggtgtggtagtggtgctgagtggcttccagaaccccttccgctccgagctgcgagataaggccctagagcttggggccaagtatcggccagactggacccgggacagcacgcacctcatctgtgcctttgccaacacccccaagtacagccaggtcctaggcctgggaggccgcatcgtgcgtaaggagtgggtgctggactgtcaccgcatgcgtcggcggctgccctcccagaggtacctcatggcagggccaggttccagcagtgaggaggatgaggcctctcacagcggtggcagcggagatgaagcccccaagcttcctcagaagcaaccccagaccaaaaccaagcccactcaggcagctggacccagctcaccccagaagcccccaacccctgaagagaccaaagcagcctcaccagtgctccaggaagatatagacattgagggggtacagtcagaaggacaggacaatggggcggaagattctggggacacagaggatgagctgaggagggtggcagagcagaaggaacacagactgccccctggccaggaggagaatggggaagacccgtatgcaggctccacggatgagaacacggacagtgaggaacaccaggagcctcctgatctgccagtccctgagctcccagatttcttccagggcaagcacttctttctttacggggagttccctggggacgagcggcggaaactcatccgatacgtcacagccttcaatggggagctcgaggacaatatgagtgaccgggttcagtttgtgatcacagcacaggaatgggatcccagctttgaggaggccctgatggacaacccctccctggcattcgttcgtccccgatggatctacagttgcaatgagaagcagaagttacttcctcaccagctctatggggtggtgccgcaagcctgaagtatgtgctatacacacacacacacacacacacacacacacacacacacgatgcatttaataaagatgagttggttctcatccaagagtctcccaaaactctaagaggctccctgggacctggggaagaatgctgggcacctccgtcagagatctggtagagaaggaactctttgtctcttctgcttggccccttatccctgtgttggcaagaggcagggaactgggaatctgaccctcagcactgcccctcaactttttctggccctctgagccacacctgtatcttggctgtccctttgtggctggaggcctgggtacccatgaggcttgtctctctcctgaagcctca

SEQ ID NO: 108 - DNA, 3067 bp, Homo sapiens
  >XRCC2|ENSG00000196584|ENST00000359321|3067
tttgactggccgtagagtctgcgcagttggtgaatggcgttggtggcgggaaagttgagtctctcctgcgccgagccttcggggcgatgtgtagtgccttccatagggctgagtctgggaccgagctccttgcccgacttgaaggtagaagttccttgaaagaaatagaaccaaatctgtttgctgatgaagattcacctgtgcatggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttctttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaaagctggaggcatcacgctacccagcttcaaactatactacaaggctacagtaaccaaaacagcatagtactggcacaaaaacacacgtagactgatggaacagaatagagaatttagaaatgagaccacacacctataatttttttgatcttcgatgaacctgacaaaaacaagcaatgggcaatggattctctattcaataaatcgtgctgggataactggccagccatatggaaaagattgaaaatggacgccttccttatgccatatacaaaaattaactcaagatggattaaagacttaatgtaaaacccaaaacagtaaaaatcctggaagacaacccaggcagtaccattcaggacataggcacaggcaaagatttcatgacgaagacgccaaaaacaattgcaacagaagcaaaaattcacaaatgggatctaattaaactaaagagctgcacagcaaaagaaactatcaagagagtaaacagacagcttacagaatgggagaaaattgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctct

SEQ ID NO: 109 - DNA, 3018 bp, Homo sapiens
  >XRCC3|ENSG00000126215|ENST00000553264|3018
ctccctgagcaggctgaacatgggcatacgagtgaccagcgtgatcgtgtccaggccagtgccgcattctgtgtggtccaagggaaaaccttctccaagtccacggcccgccctttcctctgctgggttacggccaagggcgccaggcctcactggaggacatggatcctggacccggccctcgaggctgctgccttccagtttccccatgtcctggacactcttggtctcaccatttgggaggccgacaggggatgcagagtggcctgttggaaaggccttatgtgaccccaggctgagtccctgagcagcctgctgaggccggaggggagaagagctgagcttctcccttgctgggccaggctcgggctgtggaatggctgccagctcccttcctgggagaggctgggtggggtccacagcaccttcctcccgtcccacaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgc

SEQ ID NO: 110 - DNA, 1636 bp, Homo sapiens
  >XRCC4|ENSG00000152422|ENST00000511817|1636
accggaagtagagtcacggagaggtaggatccggaagtggggctgcctctttaaataacaaaaatctgaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaattctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattctgaacattgatgtttgaacattttaatttgtgtgatgatgtagaaaatataattttagtttgtacataaacattgtgaaaatctgataataaaatttttgatacattgaagattttgtgtttttaataaaatgtgtt

SEQ ID NO: 111 - DNA, 2709 bp, Homo sapiens
  >XRCC6|ENSG00000196419|ENST00000359308|2709
gcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtacta

SEQ ID NO: 112 - protein, 2843 aa, Homo sapiens
  >APC|ENSG00000134982|ENST00000457016|8532
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 113 - protein, 2285 aa, Homo sapiens
  >ARID1A|ENSG00000117713|ENST00000324856|6858
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 114 - protein, 275 aa, Homo sapiens
  >ATG5|ENSG00000057663|ENST00000369076|828
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 115 - protein, 3056 aa, Homo sapiens
  >ATM|ENSG00000149311|ENST00000278616|9171
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQNTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 116 - protein, 2644 aa, Homo sapiens
  >ATR|ENSG00000175054|ENST00000350721|7935
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 117 - protein, 791 aa, Homo sapiens
  >ATRIP|ENSG00000164053|ENST00000320211|2376
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 118 - protein, 2492 aa, Homo sapiens
  >ATRX|ENSG00000085224|ENST00000373344|7479
MTAEPMSESKLNTLVQKLHDFLAHSSEESEETSSPPRLAMNQNTDKISGSGSNSDMMENSKEEGTSSSEKSKSSGSSRSKRKPSIVTKYVESDDEKPLDDETVNEDASNENSENDITMQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLSNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKEVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKGLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 119 - protein, 729 aa, Homo sapiens
  >BAP1|ENSG00000163930|ENST00000460680|2190
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 120 - protein, 777 aa, Homo sapiens
  >BARD1|ENSG00000138376|ENST00000260947|2334
MPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 121 - protein, 1417 aa, Homo sapiens
  >BLM|ENSG00000197299|ENST00000355112|4254
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 122 - protein, 766 aa, Homo sapiens [sequence omitted]

SEQ ID NO: 123 - protein, 1884 aa, Homo sapiens
  >BRCA1|ENSG00000012048|ENST00000471181|5655
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDSHIHGQRNNSMFSKRPREHISVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 124 - protein, 3418 aa, Homo sapiens [sequence omitted]

SEQ ID NO: 125 - protein, 1249 aa, Homo sapiens
  >BRIP1|ENSG00000136492|ENST00000259008|3750
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPPSERNGTSSTCQDSPEKTTLAAKLSAKKQASIYRDENDDFQVEKKRIRPLETTQQIRKRHCFGTEVHNLDAKVDSGKTVKLNSPLEKINSFSPQKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTSPYLLEAASHLSPENFVEDEAKICVQELQCPKIITKNSPLPSSIISRKEKNDPVFLEEAGKAEKIVISRSTSPTFNKQTKRVSWSSFNSLGQYFTGKIPKATPELGSSENSASSPPRFKTEKMESKTVLPFTDKCESSNLTVNTSFGSCPQSETIISSLKIDATLTRKNHSEHPLCSEEALDPDIELSLVSEEDKQSTSNRDFETEAEDESIYFTPELYDPEDTDEEKNDLAETDRGNRLANNSDCILAKDLFEIRTIKEVDSAREVKAEDCIDTKLNGILHIEESKIDDIDGNVKTTWINELELGKTHEIEIKNFKPSPSKNKGMFPGFK

SEQ ID NO: 126 - protein, 295 aa, Homo sapiens
  >CCND1|ENSG00000110092|ENST00000227507|888
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 127 - protein, 410 aa, Homo sapiens
  >CCNE1|ENSG00000105173|ENST00000262643|1233
MPRERRERDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 128 - protein, 404 aa, Homo sapiens
  >CCNE2|ENSG00000175305|ENST00000520509|1215
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 129 - protein, 574 aa, Homo sapiens
  >CDC7|ENSG00000097046|ENST00000428239|1725
MEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 130 - protein, 1490 aa, Homo sapiens
  >CDK12|ENSG00000167258|ENST00000447079|4473
MPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAACPPHILPPEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 131 - protein, 476 aa, Homo sapiens
  >CHEK1|ENSG00000149554|ENST00000534070|1431
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKIWLPAT

SEQ ID NO: 132 - protein, 586 aa, Homo sapiens
  >CHEK2|ENSG00000183765|ENST00000382580|1761
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRGVRHHPRPVCSLKCVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 133 - protein, 1040 aa, Homo sapiens
  >DCLRE1A|ENSG00000198924|ENST00000361384|3123
MLEDISEEDIWEYKSKRKPKRVDPNNGSKNILKSVEKATDGKYQSKRSRNRKRAAEAKEVKDHEVPLGNAGCQTSVASSQNSSCGDGIQQTQDKETTPGKLCRTQKSQHVSPKIRPVYDGYCPNCQMPFSSLIGQTPRWHVFECLDSPPRSETECPDGLLCTSTIPFHYKRYTHFLLAQSRAGDHPFSSPSPASGGSFSETKSGVLCSLEERWSSYQNQTDNSVSNDPLLMTQYFKKSPSLTEASEKISTHIQTSQQALQFTDFVENDKLVGVALRLANNSEHINLPLPENDFSDCEISYSPLQSDEDTHDIDEKPDDSQEQLFFTESSKDGSLEEDDDSCGFFKKRHGPLLKDQDESCPKVNSFLTRDKYDEGLYRFNSLNDLSQPISQNNESTLPYDLACTGGDFVLFPPALAGKLAASVHQATKAKPDEPEFHSAQSNKQKQVIEESSVYNQVSLPLVKSLMLKPFESQVEGYLSSQPTQNTIRKLSSENLNAKNNTNSACFCRKALEGVPVGKATILNTENLSSTPAPKYLKILPSGLKYNARHPSTKVMKQMDIGVYFGLPPKRKEEKLLGESALEGINLNPVPSPNQKRSSQCKRKAEKSLSDLEFDASTLHESQLSVELSSERSQRQKKRCRKSNSLQEGACQKRSDHLINTESEAVNLSKVKVFTKSAHGGLQRGNKKIPESSNVGGSRKKTCPFYKKIPGTGFTVDAFQYGVVEGCTAYFLTHFHSDHYAGLSKHFTFPVYCSEITGNLLKNKLHVQEQYIHPLPLDTECIVNGVKVVLLDANHCPGAVMILFYLPNGTVILHTGDFRADPSMERSLLADQKVHMLYLDTTYCSPEYTFPSQQEVIRFAINTAFEAVTLNPHALVVCGTYSIGKEKVFLAIADVLGSKVGMSQEKYKTLQCLNIPEINSLITTDMCSSLVHLLPMMQINFKGLQSHLKKCGGKYNQILAFRPTGWTHSNKFTRIADVIPQTKGNISIYGIPYSEHSSYLEMKRFVQWLKPQKIIPTVNVGTWKSRSTMEKYFREWKLEAGY

SEQ ID NO: 134 - protein, 532 aa, Homo sapiens
  >DCLRE1B|ENSG00000118655|ENST00000369563|1599
MNGVLIPHTPIAVDFWSLRRAGTARLFFLSHMHSDHTVGLSSTWARPLYCSPITAHLLHRHLQVSKQWIQALEVGESHVLPLDEIGQETMTVTLLDANHCPGSVMFLFEGYFGTILYTGDFRYTPSMLKEPALTLGKQIHTLYLDNTNCNPALVLPSRQEAAHQIVQLIRKHPQHNIKIGLYSLGKESLLEQLALEFQTWVVLSPRRLELVQLLGLADVFTVEEKAGRIHAVDHMEICHSNMLRWNQTHPTIAILPTSRKIHSSHPDIHVIPYSDHSSYSELRAFVAALKPCQVVPIVSRRPCGGFQDSLSPRISVPLIPDSVQQYMSSSSRKPSLLWLLERRLKRPRTQGVVFESPEESADQSQADRDSKKAKKEKLSPWPADLEKQPSHHPLRIKKQLFPDLYSKEWNKAVPFCESQKRVTMLTAPLGFSVHLRSTDEEFISQKTREEIGLGSPLVPMGDDDGGPEATGNQSAWMGHGSPLSHSSKGTPLLATEFRGLALKYLLTPVNFFQAGYSSRRFDQQVEKYHKPC

SEQ ID NO: 135 - protein, 692 aa, Homo sapiens
  >DCLRE1C|ENSG00000152457|ENST00000378278|2079
MSSFEGQMAEYPTISIDRFDRENLRARAYFLSHCHKDHMKGLRAPTLKRRLECSLKVYLYCSPVTKELLLTSPKYRFWKKRIISIEIETPTQISLVDEASGEKEEIVVTLLPAGHCPGSVMFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 136 - protein, 763 aa, Homo sapiens
  >DYRK1A|ENSG00000157540|ENST00000398960|2292
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 137 - protein, 1210 aa, Homo sapiens [sequence omitted]

SEQ ID NO: 138 - protein, 1255 aa, Homo sapiens [sequence omitted]

SEQ ID NO: 139 - protein, 1342 aa, Homo sapiens
  >ERBB3|ENSG00000065361|ENST00000267101|4029
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 140 - protein, 760 aa, Homo sapiens
  >ERCC2|ENSG00000104884|ENST00000391945|2283
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 141 - protein, 782 aa, Homo sapiens
  >ERCC3|ENSG00000163161|ENST00000285398|2349
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 142 - protein, 916 aa, Homo sapiens
  >ERCC4|ENSG00000175595|ENST00000311895|2751
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAEVVSKGKGKK

SEQ ID NO: 143 - protein, 1186 aa, Homo sapiens
  >ERCC5|ENSG00000134899|ENST00000355739|3561
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 144 - protein, 409 aa, Homo sapiens
  >FAM175A|ENSG00000163322|ENST00000321945|1230
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 145 - protein, 1455 aa, Homo sapiens
  >FANCA|ENSG00000187741|ENST00000389301|4368
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPGKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 146 - protein, 859 aa, Homo sapiens
  >FANCB|ENSG00000181544|ENST00000398334|2580
MTSKQAMSSNEQERLLCYNGEVLVFQLSKGNFADKEPTKTPILHVRRMVFDRGTKVFVQKSTGFFTIKEENSHLKIMCCNCVSDFRTGINLPYIVIEKNKKNNVFEYFLLILHSTNKFEMRLSFKLGYEMKDGLRVLNGPLILWRHVKAFFFISSQTGKVVSVSGNFSSIQWAGEIENLGMVLLGLKECCLSEEECTQEPSKSDYAIWNTKFCVYSLESQEVLSDIYIIPPAYSSVVTYVHICATEIIKNQLRISLIALTRKNQLISFQNGTPKNVCQLPFGDPCAVQLMDSGGGNLFFVVSFISNNACAVWKESFQVAAKWEKLSLVLIDDFIGSGTEQVLLLFKDSLNSDCLTSFKITDLGKINYSSEPSDCNEDDLFEDKQENRYLVVPPLETGLKVCFSSFRELRQHLLLKEKIISKSYKALINLVQGKDDNTSSAEEKECLVPLCGEEENSVHILDEKLSDNFQDSEQLVEKIWYRVIDDSLVVGVKTTSSLKLSLNDVTLSLLMDQAHDSRFRLLKCQNRVIKLSTNPFPAPYLMPCEIGLEAKRVTLTPDSKKEESFVCEHPSKKECVQIITAVTSLSPLLTFSKFCCTVLLQIMERESGNCPKDRYVVCGRVFLSLEDLSTGKYLLTFPKKKPIEHMEDLFALLAAFHKSCFQITSPGYALNSMKVWLLEHMKCEIIKEFPEVYFCERPGSFYGTLFTWKQRTPFEGILIIYSRNQTVMFQCLHNLIRILPINCFLKNLKSGSENFLIDNMAFTLEKELVTLSSLSSAIAKHESNFMQRCEVSKGKSSVVAAALSDRRENIHPYRKELQREKKKMLQTNLKVSGALYREITLKVAEVQLKSDFAAQKLSNL

SEQ ID NO: 147 - protein, 558 aa, Homo sapiens
  >FANCC|ENSG00000158169|ENST00000289081|1677
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLLKNMVLSLASELRENHLNGFNTQRRMAPERVASLSRVCVPLITLTDVDPLVEALLICHGREPQEILQPEFFEAVNEAILLKKISLPMSAVVCLWLRHLPSLEKAMLHLFEKLISSERNCLRRIECFIKDSSLPQAACHPAIFRVVDEMFRCALLETDGALEIIATIQVFTQCFVEALEKASKQLRFALKTYFPYTSPSLAMVLLQDPQDIPRGHWLQTLKHISELLREAVEDQTHGSCGGPFESWFLFIHFGGWAEMVAEQLLMSAAEPPTALLWLLAFYYGPRDGRQQRAQTMVQVKAVLGHLLAMSRSSSLSAQDLQTVAGQGTDTDLRAPAQQLIRHLLLNFLLWAPGGHTIAWDVITLMAHTAEITHEIIGFLDQTLYRWNRLGIESPRSEKLARELLKELRTQV

SEQ ID NO: 148 - protein, 1471 aa, Homo sapiens
  >FANCD2|ENSG00000144554|ENST00000287647|4416
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEVSLQNPPESGTDGCILLIVLSWWSRTLPTYVYCQMLLCPFPFPP

SEQ ID NO: 149 - protein, 536 aa, Homo sapiens
  >FANCE|ENSG00000112039|ENST00000229769|1611
MATPDAGLPGAEGVEPAPWAQLEAPARLLLQALQAGPEGARRGLGVLRALGSRGWEPFDWGRLLEALCREEPVVQGPDGRLELKPLLLRLPRICQRNLMSLLMAVRPSLPESGLLSVLQIAQQDLAPDPDAWLRALGELLRRDLGVGTSMEGASPLSERCQRQLQSLCRGLGLGGRRLKSPQAPDPEEEENRDSQQPGKRRKDSEEEAASPEGKRVPKRLRCWEEEEDHEKERPEHKSLESLADGGSASPIKDQPVMAVKTGEDGSNLDDAKGLAESLELPKAIQDQLPRLQQLLKTLEEGLEGLEDAPPVELQLLHECSPSQMDLLCAQLQLPQLSDLGLLRLCTWLLALSPDLSLSNATVLTRSLFLGRILSLTSSASRLLTTALTSFCAKYTYPVCSALLDPVLQAPGTGPAQTELLCCLVKMESLEPDAQVLMLGQILELPWKEETFLVLQSLLERQVEMTPEKFSVLMEKLCKKGLAATTSMAYAKLMLTVMTKYQANITETQRLGLAMALEPNTTFLRKSLKAALKHLGP

SEQ ID NO: 150 - protein, 374 aa, Homo sapiens
  >FANCF|ENSG00000183161|ENST00000327470|1125
MESLLQHLDRFSELLAVSSTTYVSTWDPATVRRALQWARYLRHIHRRFGRHGPIRTALERRLHNQWRQEGGFGRGPVPGLANFQALGHCDVLLSLRLLENRALGDAARYHLVQQLFPGPGVRDADEETLQESLARLARRRSAVHMLRFNGYRENPNLQEDSLMKTQAELLLERLQEVGKAEAERPARFLSSLWERLPQNNFLKVIAVALLQPPLSRRPQEELEPGIHKSPGEGSQVLVHWLLGNSEVFAAFCRALPAGLLTLVTSRHPALSPVYLGLLTDWGQRLHYDLQKGIWVGTESQDVPWEELHNRFQSLCQAPPPLKDKVLTALETCKAQDGDFEVPGLSIWTDLLLALRSGAFRKRQVLGLSAGLSSV

SEQ ID NO: 151 - protein, 622 aa, Homo sapiens
  >FANCG|ENSG00000221829|ENST00000378643|1869
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 152 - protein, 1328 aa, Homo sapiens
  >FANCI|ENSG00000140525|ENST00000310775|3987
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRDSIQSHQESLSVLRSSNEFMRYAVNVALQKVQQLKETGHVSGPDGQNPEKIFQNLCDITRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 153 - protein, 380 aa, Homo sapiens
  >FANCL|ENSG00000115392|ENST00000402135|1143
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQVNSPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 154 - protein, 2048 aa, Homo sapiens
  >FANCM|ENSG00000187790|ENST00000267430|6147
MSGRQRTLFQTWGSSISRSSGTPGCSSGTERPQSPGSSKAPLPAAAEAQLESDDDVLLVAAYEAERQLCLENGGFCTSAGALWIYPTNCPVRDYQLHISRAALFCNTLVCLPTGLGKTFIAAVVMYNFYRWFPSGKVVFMAPTKPLVTQQIEACYQVMGIPQSHMAEMTGSTQASTRKEIWCSKRVLFLTPQVMVNDLSRGACPAAEIKCLVIDEAHKALGNYAYCQVVRELVKYTNHFRILALSATPGSDIKAVQQVITNLLIGQIELRSEDSPDILTYSHERKVEKLIVPLGEELAAIQKTYIQILESFARSLIQRNVLMRRDIPNLTKYQIILARDQFRKNPSPNIVGIQQGIIEGEFAICISLYHGYELLQQMGMRSLYFFLCGIMDGTKGMTRSKNELGRNEDFMKLYNHLECMFARTRSTSANGISAIQQGDKNKKFVYSHPKLKKLEEVVIEHFKSWNAENTTEKKRDETRVMIFSSFRDSVQEIAEMLSQHQPIIRVMTFVGHASGKSTKGFTQKEQLEVVKQFRDGGYNTLVSTCVGEEGLDIGEVDLIICFDSQKSPIRLVQRMGRTGRKRQGRIVIILSEGREERIYNQSQSNKRSIYKAISSNRQVLHFYQRSPRMVPDGINPKLHKMFITHGVYEPEKPSRNLQRKSSIFSYRDGMRQSSLKKDWFLSEEEFKLWNRLYRLRDSDEIKEITLPQVQFSSLQNEENKPAQESTTGIHQLSLSEWRLWQDHPLPTHQVDHSDRCRHFIGLMQMIEGMRHEEGECSYELEVESYLQMEDVTSTFIAPRNESNNLASDTFITHKKSSFIKNINQGSSSSVIESDEECAEIVKQTHIKPTKIVSLKKKVSKEIKKDQLKKENNHGIIDSVDNDRNSTVENIFQEDLPNDKRTSDTDEIAATCTINENVIKEPCVLLTECQFTNKSTSSLAGNVLDSGYNSFNDEKSVSSNLFLPFEEELYIVRTDDQFYNCHSLTKEVLANVERFLSYSPPPLSGLSDLEYEIAKGTALENLLFLPCAEHLRSDKCTCLLSHSAVNSQQNLELNSLKCINYPSEKSCLYDIPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSSKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPINRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLPQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 155 - protein, 1094 aa, Homo sapiens
  >FBXO18|ENSG00000134452|ENST00000379999|3285
MSYEVTSGCHWTCQVPESCDNGLHCAGPLGHLHRRCQRTSAHLLVFTEHAEMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 156 - protein, 707 aa, Homo sapiens
  >FBXW7|ENSG00000109670|ENST00000281708|2124
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 157 - protein, 380 aa, Homo sapiens
  >FEN1|ENSG00000168496|ENST00000305885|1143
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 158 - protein, 908 aa, Homo sapiens
  >GEN1|ENSG00000178295|ENST00000381254|2727
MGVNDLWQILEPVKQHIPLRNLGGKTIAVDLSLWVCEAQTVKKMMGSVMKPHLRNLFFRISYLTQMDVKLVFVMEGEPPKLKADVISKRNQSRYGSSGKSWSQKTGRSHFKSVLRECLHMLECLGIPWVQAAGEAEAMCAYLNAGGHVDGCLTNDGDTFLYGAQTVYRNFTMNTKDPHVDCYTMSSIKSKLGLDRDALVGLAILLGCDYLPKGVPGVGKEQALKLIQILKGQSLLQRFNRWNETSCNSSPQLLVTKKLAHCSVCSHPGSPKDHERNGCRLCKSDKYCEPHDYEYCCPCEWHRTEHDRQLSEVENNIKKKACCCEGFPFHEVIQEFLLNKDKLVKVIRYQRPDLLLFQRFTLEKMEWPNHYACEKLLVLLTHYDMIERKLGSRNSNQLQPIRIVKTRIRNGVHCFEIEWEKPEHYAMEDKQHGEFALLTIEEESLFEAAYPEIVAVYQKQKLEIKGKKQKRIKPKENNLPEPDEVMSFQSHMTLKPTCEIFHKQNSKLNSGISPDPTLPQESISASLNSLLLPKNTPCLNAQEQFMSSLRPLAIQQIKAVSKSLISESSQPNTSSHNISVIADLHLSTIDWEGTSFSNSPAIQRNTFSHDLKSEVESELSAIPDGFENIPEQLSCESERYTANIKKVLDEDSDGISPEEHLLSGITDLCLQDLPLKERIFTKLSYPQDNLQPDVNLKTLSILSVKESCIANSGSDCTSHLSKDLPGIPLQNESRDSKILKGDQLLQEDYKVNTSVPYSVSNTVVKTCNVRPPNTALDHSRKVDMQTTRKILMKKSVCLDRHSSDEQSAPVFGKAKYTTQRMKHSSQKHNSSHFKESGHNKLSSPKIHIKETEQCVRSYETAENEESCFPDSTKSSLSSLQCHKKENNSGTCLDSPLPLRQRLKLRFQST

SEQ ID NO: 159 - protein, 143 aa, Homo sapiens
  >H2AFX|ENSG00000188486|ENST00000530167|432
MSGRGKTGGKARAKAKSRSSRAGLQFPVGRVHRLLRKGHYAERVGAGAPVYLAAVLEYLTAEILELAGNAARDNKKTRIIPRHLQLAIRNDEELNKLLGGVTIAQGGVLPNIQAVLLPKKTSATVGPKAPSGGKKATQASQEY

SEQ ID NO: 160 - protein, 488 aa, Homo sapiens
  >HDAC2|ENSG00000196591|ENST00000519065|1467
MAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 161 - protein, 189 aa, Homo sapiens
  >HRAS|ENSG00000174775|ENST00000451590|570
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 162 - protein, 189 aa, Homo sapiens [sequence omitted]

SEQ ID NO: 163 - protein, 911 aa, Homo sapiens
  >LIG4|ENSG00000174405|ENST00000356922|2736
MAASQTSQTVASHVPFADLCSTLERIQKSKGRAEKIRHFREFLDSWRKFHDALHKNHKDVTDSFYPAMRLILPQLERERMAYGIKETMLAKLYIELLNLPRDGKDALKLLNYRTPTGTHGDAGDFAMIAYFVLKPRCLQKGSLTIQQVNDLLDSIASNNSAKRKDLIKKSLLQLITQSSALEQKWLIRMIIKDLKLGVSQQTIFSVFHNDAAELHNVTTDLEKVCRQLHDPSVGLSDISITLFSAFKPMLAAIADIEHIEKDMKHQSFYIETKLDGERMQMHKDGDVYKYFSRNGYNYTDQFGASPTEGSLTPFIHNAFKADIQICILDGEMMAYNPNTQTFMQKGTKFDIKRMVEDSDLQTCYCVFDVLMVNNKKLGHETLRKRYEILSSIFTPIPGRIEIVQKTQAHTKNEVIDALNEAIDKREEGIMVKQPLSIYKPDKRGEGWLKIKPEYVSGLMDELDILIVGGYWGKGSRGGMMSHFLCAVAEKPPPGEKPSVFHTLSRVGSGCTMKELYDLGLKLAKYWKPFHRKAPPSSILCGTEKPEVYIEPCNSVIVQIKAAEIVPSDMYKTGCTLRFPRIEKIRDDKEWHECMTLDDLEQLRGKASGKLASKHLYIGGDDEPQEKKRKAAPKMKKVIGIIEHLKAPNLTNVNKISNIFEDVEFCVMSGTDSQPKPDLENRIAEFGGYIVQNPGPDTYCVIAGSENIRVKNIILSNKHDVVKPAWLLECFKTKSFVPWQPRFMIHMCPSTKEHFAREYDCYGDSYFIDTDLNQLKEVFSGIKNSNEQTPEEMASLIADLEYRYSWDCSPLSMFRRHTVYLDSYAVINDLSTKNEGTRLAIKALELRFHGAKVVSCLAEGVSHVIIGEDHSRVADFKAFRRTFKRKFKILKESWVTDSIDKCELQEENQYLI

SEQ ID NO: 164 - protein, 2089 aa, Homo sapiens
  >MDC1|ENSG00000137337|ENST00000376406|6270
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 165 - protein, 756 aa, Homo sapiens
  >MLH1|ENSG00000076242|ENST00000231790|2271
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 166 - protein, 1453 aa, Homo sapiens
  >MLH3|ENSG00000119684|ENST00000355774|4362
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 167 - protein, 708 aa, Homo sapiens
  >MRE11A|ENSG00000020922|ENST00000323929|2127
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 168 - protein, 934 aa, Homo sapiens [sequence omitted]

SEQ ID NO: 169 - protein, 1137 aa, Homo sapiens
  >MSH3|ENSG00000113318|ENST00000265081|3414
MSRRKPASGGLAASSSAPARQAVLSRFFQSTGSLKSTSSSTGAADQVDPGAAAAAAAAAAAAPPAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 170 - protein, 1360 aa, Homo sapiens
  >MSH6|ENSG00000116062|ENST00000234420|4083
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 171 - protein, 454 aa, Homo sapiens
  >MYC|ENSG00000136997|ENST00000377970|1365
LDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 172 - protein, 754 aa, Homo sapiens
  >NBN|ENSG00000104320|ENST00000265433|2265
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 173 - protein, 189 aa, Homo sapiens
  >NRAS|ENSG00000213281|ENST00000369535|570
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 174 - protein, 1186 aa, Homo sapiens [sequence omitted]

SEQ ID NO: 175 - protein, 1014 aa, Homo sapiens
  >PARP1|ENSG00000143799|ENST00000366794|3045
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 176 - protein, 583 aa, Homo sapiens
  >PARP2|ENSG00000129484|ENST00000250416|1752
MAARRRRSTGGGRARALNESKRVNNGNTAPEDSSPAKKTRRCQRQESKKMPVAGGKANKDRTEDKQDGMPGRSWASKRVSESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 177 - protein, 540 aa, Homo sapiens
  >PARP3|ENSG00000041880|ENST00000398755|1623
MSLLFLAMAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNHWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 178 - protein, 1724 aa, Homo sapiens
  >PARP4|ENSG00000102699|ENST00000381989|5175
MVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQIALHALSLVGEKQKVNIIQFGTGYKELFSYPKHITSNTMAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDVPEALQAPAQVPSLFLNDRLLVYGFIPHCTQATLCALIQEKEFRTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLPPTARAHSPASLSFASYRQVASFGSAAPPRQFDASQFSQGPVPGTCADWIPQSASCPTGPPQNPPSSPYCGIVFSGSSLSSAQSAPLQHPGGFTTRPSAGTFPELDSPQLHFSLPTDPDPIRGFGSYHPSASSPFHFQPSAASLTANLRLPMASALPEALCSQSRTTPVDLCLLEESVGSLEGSRCPVFAFQSSDTESDELSEVLQDSCFLQIKCDTKDDSILCFLEVKEEDEIVCIQHWQDAVPWTELLSLQTEDGFWKLTPELGLILNLNTNGLHSFLKQKGIQSLGVKGRECLLDLIATMLVLQFIRTRLEKEGIVFKSLMKMDDASISRNIPWAFEAIKQASEWVRRTEGQYPSICPRLELGNDWDSATKQLLGLQPISTVSPLHRVLHYSQG

SEQ ID NO: 179 - protein, 261 aa, Homo sapiens
  >PCNA|ENSG00000132646|ENST00000379160|786
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 180 - protein, 1068 aa, Homo sapiens
  >PIK3CA|ENSG00000121879|ENST00000263967|3207
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 181 - protein, 862 aa, Homo sapiens
  >PMS2|ENSG00000122512|ENST00000265849|2589
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 182 - protein, 1462 aa, Homo sapiens
  >POLA1|ENSG00000101868|ENST00000379059|4389
MAPVHGDDSLSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKSPQLLNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKAAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 183 - protein, 335 aa, Homo sapiens
  >POLB|ENSG00000070501|ENST00000265421|1008
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 184 - protein, 713 aa, Homo sapiens
  >POLH|ENSG00000170734|ENST00000372236|2142
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 185 - protein, 575 aa, Homo sapiens
  >POLL|ENSG00000166169|ENST00000370162|1728
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 186 - protein, 900 aa, Homo sapiens
  >POLN|ENSG00000130997|ENST00000511885|2703
MENYEALVGFDLCNTPLSSVAQKIMSAMHSGDLVDSKTWGKSTETMEVINKSSVKYSVQLEDRKTQSPEKKDLKSLRSQTSRGSAKLSPQSFSVRLTDQLSADQKQKSISSLTLSSCLIPQYNQEASVLQKKGHKRKHFLMENINNENKGSINLKRKHITYNNLSEKTSKQMALEEDTDDAEGYLNSGNSGALKKHFCDIRHLDDWAKSQLIEMLKQAAALVITVMYTDGSTQLGADQTPVSSVRGIVVLVKRQAEGGHGCPDAPACGPVLEGFVSDDPCIYIQIEHSAIWDQEQEAHQQFARNVLFQTMKCKCPVICFNAKDFVRIVLQFFGNDGSWKHVADFIGLDPRIAAWLIDPSDATPSFEDLVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEAVLNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVQALELQLQVPLKVSLSAGRSWGHLVPLQEAWGPPPGPCRTESPSNSLAAPGSPASTQPPPLHFSPSFCL

SEQ ID NO: 187 - protein, 2590 aa, Homo sapiens
  >POLQ|ENSG00000051341|ENST00000264233|7773
MNLLRRSGKRRRSESGSDSFSGSGGDSSASPQFLSGSVLSPPPGLGRCLKAAAAGECKPTVPDYERDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGESILICKNSEKSKGIALLQGSLKPVRSCLQRREGEEVTGSMIRAILEIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 188 - protein, 4127 aa, Homo sapiens
  >PRKDC|ENSG00000253729|ENST00000314191|12384
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 189 - protein, 403 aa, Homo sapiens [sequence omitted]

SEQ ID NO: 190 - protein, 681 aa, Homo sapiens
  >RAD17|ENSG00000152942|ENST00000509734|2046
MSKTFLRPKVSSTKVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 191 - protein, 495 aa, Homo sapiens
  >RAD18|ENSG00000070950|ENST00000264926|1488
MDSLAESRWPPGLAVMKTIDDLLRCGICFEYFNIAMIIPQCSHNYCSLCIRKFLSYKTQCPTCCVTVTEPDLKNNRILDELVKSLNFARNHLLQFALESPAKSPASSSSKNLAVKVYTPVASRQSLKQGSRLMDNFLIREMSGSTSELLIKENKSKFSPQKEASPAAKTKETRSVEEIAPDPSEAKRPEPPSTSTLKQVTKVDCPVCGVNIPESHINKHLDSCLSREEKKESLRSSVHKRKPLPKTVYNLLSDRDLKKKLKEHGLSIQGNKQQLIKRHQEFVHMYNAQCDALHPKSAAEIVREIENIEKTRMRLEASKLNESVMVFTKDQTEKEIDEIHSKYRKKHKSEFQLLVDQARKGYKKIAGMSQKTVTITKEDESTEKLSSVCMGQEDNMTSVTNHFSQSKLDSPEELEPDREEDSSSCIDIQEVLSSSESDSCNSSSSDIIRDLLEEEEAWEASHKNDLQDTEISPRQNRRTRAAESAEIEPRNKRNRN

SEQ ID NO: 192 - protein, 1312 aa, Homo sapiens
  >RAD50|ENSG00000113522|ENST00000265335|3939
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 193 - protein, 340 aa, Homo sapiens
  >RAD51|ENSG00000051180|ENST00000382643|1023
MAMQMQLEANADTSVEEESFGPQPISRLEQCGINANDVKKLEEAGFHTVEAVAYAPKKELINIKGISEAKADKILTESRSVARLECNSVILVYCTLRLSGSSDSPASASRVVGTTGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 194 - protein, 418 aa, Homo sapiens
  >RAD52|ENSG00000002016|ENST00000358495|1257
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRSFGNALGNCILDKDYLRSLNKLPRQLPLEVDLTKAKRQDLEPSVEEARYNSCRPNMALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 195 - protein, 910 aa, Homo sapiens
  >RAD54B|ENSG00000197275|ENST00000336148|2733
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVHSAPKEVAVSKEQEEKSDSLVKYFSVVWCKPSKKKHKKWEGDAVLIVKGKSFILKNLEGKDIGRGIGYKFKELEKIEEGQTLMICGKEIEVMGVISPDDFSSGRCFQLGGGSTAISHSSQVARKCFSNPFKSVCKPSSKENRQNDFQNCKPRHDPYTPNSLVMPRPDKNHQWVFNKNCFPLVDVVIDPYLVYHLRPHQKEGIIFLYECVMGMRMNGRCGAILADEMGLGKTLQCISLIWTLQCQGPYGGKPVIKKTLIVTPGSLVNNWKKEFQKWLGSERIKIFTVDQDHKVEEFIKSIFYSVLIISYEMLLRSLDQIKNIKFDLLICDEGHRLKNSAIKTTTALISLSCEKRIILTGTPIQNDLQEFFALIDFVNPGILGSLSSYRKIYEEPIILSREPSASEEEKELGERRAAELTCLTGLFILRRTQEIINKYLPPKIENVVFCRPGALQIELYRKLLNSQVVRFCLQGLLENSPHLICIGALKKLCNHPCLLFNSIKEKECSSTCDKNEEKSLYKGLLSVFPADYNPLLFTEKESGKLQVLSKLLAVIHELRPTEKVVLVSNYTQTLNILQEVCKRHGYAYTRLDGQTPISQRQQIVDGFNSQHSSFFIFLLSSKAGGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 196 - protein, 747 aa, Homo sapiens
  >RAD54L|ENSG00000085999|ENST00000371975|2244
MRRSLAPSQLAKRKPEGRSCDDEDWQPGLVTPRKRKSSSETQIQECFLSPFRKPLSQLTNQPPCLDSSQHEAFIRSILSKPFKVPIPNYQGPLGSRALGLKRAGVRRALHDPLEKDALVLYEPPPLSAHDQLKLDKEKLPVHVVVDPILSKVLRPHQREGVKFLWECVTSRRIPGSHGCIMADEMGLGKTLQCITLMWTLLRQSPECKPEIDKAVVVSPSSLVKNWYNEVGKWLGGRIQPLAIDGGSKDEIDQKLEGFMNQRGARVSSPILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 197 - protein, 391 aa, Homo sapiens
  >RAD9A|ENSG00000172613|ENST00000307980|1176
MKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 198 - protein, 928 aa, Homo sapiens
  >RB1|ENSG00000139687|ENST00000267163|2787
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 199 - protein, 3130 aa, Homo sapiens
  >REV3L|ENSG00000009413|ENST00000358835|9393
MFSVRIVTADYYMASPLQGLDTCQSPLTQAPVKKVPVVRVFGATPAGQKTCLHLHGIFPYLYVPYDGYGQQPESYLSQMAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHTTLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRIHKATSSSRSEPEGRKGTISQYFTTLHCPVCDDLTQHGICSKCRSQPQHVAVILNQEIRELERQQEQLVKICKNCTGCFDRHIPCVSLNCPVLFKLSRVNRELSKAPYLRQLLDQF

SEQ ID NO: 200 - protein, 616 aa, Homo sapiens
  >RPA1|ENSG00000132383|ENST00000254719|1851
MVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 201 - protein, 270 aa, Homo sapiens
  >RPA2|ENSG00000117748|ENST00000373912|813
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 202 - protein, 1834 aa, Homo sapiens
  >SLX4|ENSG00000188827|ENST00000294008|5505
MKLSVNEAQLGFYLGSLSHLSACPGIDPRSSEDQPESLKTGQMMDESDEDFKELCASFFQRVKKHGIKEVSGERKTQKAASNGTQIRSKLKRTKQTATKTKTLQGPAEKKPPSGSQAPRTKKQRVTKWQASEPAHSVNGEGGVLASAPDPPVLRETAQNTQTGNQQEPSPNLSREKTRENVPNSDSQPPPSCLTTAVPSPSKPRTAQLVLQRMQQFKRADPERLRHASEECSLEAAREENVPKDPQEEMMAGNVYGLGPPAPESDAAVALTLQQEFARVGASAHDDSLEEKGLFFCQICQKNLSAMNVTRREQHVNRCLDEAEKTLRPSVPQIPECPICGKPFLTLKSRTSHLKQCAVKMEVGPQLLLQAVRLQTAQPEGSSSPPMFSFSDHSRGLKRRGPTSKKEPRKRRKVDEAPSEDLLVAMALSRSEMEPGAAVPALRLESAFSERIRPEAENKSRKKKPPVSPPLLLVQDSETTGRQIEDRVALLLSEEVELSSTPPLPASRILKEGWERAGQCPPPPERKQSFLWEGSALTGAWAMEDFYTARLVPPLVPQRPAQGLMQEPVPPLVPPEHSELSERRSPALHGTPTAGCGSRGPSPSASQREHQALQDLVDLAREGLSASPWPGSGGLAGSEGTAGLDVVPGGLPLTGFVVPSQDKHPDRGGRTLLSLGLLVADFGAMVNNPHLSDVQFQTDSGEVLYAHKFVLYARCPLLIQYVNNEGFSAVEDGVLTQRVLLGDVSTEAARTFLHYLYTADTGLPPGLSSELSSLAHRFGVSELVHLCEQVPIATDSEGKPWEEKEAENCESRAENFQELLRSMWADEEEEAETLLKSKDHEEDQENVNEAEMEEIYEFAATQRKLLQEERAAGAGEDADWLEGGSPVSGQLLAGVQVQKQWDKVEEMEPLEPGRDEAATTWEKMGQCALPPPQGQHSGARGAEAPEQEAPEEALGHSSCSSPSRDCQAERKEGSLPHSDDAGDYEQLFSSTQGEISEPSQITSEPEEQSGAVRERGLEVSHRLAPWQASPPHPCRFLLGPPQGGSPRGSHHTSGSSLSTPRSRGGTSQVGSPTLLSPAVPSKQKRDRSILTLSKEPGHQKGKERRSVLECRNKGVLMFPEKSPSIDLTQSNPDHSSSRSQKSSSKLNEEDEVILLLDSDEELELEQTKMKSISSDPLEEKKALEISPRSCELFSIIDVDADQEPSQSPPRSEAVLQQEDEGALPENRGSLGRRGAPWLFCDRESSPSEASTTDTSWLVPATPLASRSRDCSSQTQISSLRSGLAVQAVTQHTPRASVGNREGNEVAQKFSVIRPQTPPPQTPSSCLTPVSPGTSDGRRQGHRSPSRPHPGGHPHSSPLAPHPISGDRAHFSRRFLKHSPPGPSFLNQTPAGEVVEVGDSDDEQEVASHQANRSPPLDSDPPIPIDDCCWHMEPLSPIPIDHWNLERTGPLSTSSPSRRMNEAADSRDCRSPGLLDTTPIRGSCTTQRKLQEKSSGAGSLGNSRPSFLNSALWDVWDGEEQRPPETPPPAQMPSAGGAQKPEGLETPKGANRKKNLPPKVPITPMPQYSIMETPVLKKELDRFGVRPLPKRQMVLKLKEIFQYTHQTLDSDSEDESQSSQPLLQAPHCQTLASQTYKPSRAGVHAQQEATTGPGAHRPKGPAKTKGPRHQRKHHESITPPSRSPTKEAPPGLNDDAQIPASQESVATSVDGSDSSLSSQSSSSCEFGAAFESAGEEEGEGEVSASQAAVQAADTDEALRCYIRSKPALYQKVLLYQPFELRELQAELRQNGLRVSSRRLLDFLDTHCITFTTAATRREKLQGRRRQPRGKKKVERN

SEQ ID NO: 203 - protein, 608 aa, Homo sapiens
  >TDP1|ENSG00000042088|ENST00000335725|1827
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKDRPWIWNIPYVKAPDTHGNMWVPS

SEQ ID NO: 204 - protein, 362 aa, Homo sapiens
  >TDP2|ENSG00000111802|ENST00000378198|1089
MELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYLKKRSSNYEIITGHEEGYFTAIMLKKSRVKLKSQEIIPFPSTKMMRNLLCVHVNVSGNELCLMTSHLESTRGHAAERMNQLKMVLKKMQEAPESATVIFAGDTNLRDREVTRCGGLPNNIVDVWEFLGKPKHCQYTWDTQMNSNLGITAACKLRFDRIFFRAAAEEGHIIPRSLDLLGLEKLDCGRFPSDHWGLLCNLDIIL

SEQ ID NO: 205 - protein, 529 aa, Homo sapiens
  >TMPRSS2|ENSG00000184012|ENST00000398585|1590
MPPAPPGGESGCEERGAAGHIEHSRYLSLLDAVDNSKMALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 206 - protein, 1531 aa, Homo sapiens
  >TOP2A|ENSG00000131747|ENST00000423485|4596
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 207 - protein, 1621 aa, Homo sapiens
  >TOP2B|ENSG00000077097|ENST00000435706|4866
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 208 - protein, 1522 aa, Homo sapiens
  >TOPBP1|ENSG00000163781|ENST00000260810|4569
MSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHKPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQAVCDPGNIRVTEAPKHPISEELETPIKDSHLIPTPQAPSIAFPLANPPVAPHPREKIITIEETHEELKKQYIFQLSSLNPQERIDYCHLIEKLGGLVIEKQCFDPTCTHIVVGHPLRNEKYLASVAAGKWVLHRSYLEACRTAGHFVQEEDYEWGSSSILDVLTGINVQQRRLALAAMRWRKKIQQRQESGIVEGAFSGWKVILHVDQSREAGFKRLLQSGGAKVLPGHSVPLFKEATHLFSDLNKLKPDDSGVNIAEAAAQNVYCLRTEYIADYLMQESPPHVENYCLPEAISFIQNNKELGTGLSQKRKAPTEKNKIKRPRVH

SEQ ID NO: 209 - protein, 1977 aa, Homo sapiens
  >TP53BP1|ENSG00000067369|ENST00000382044|5934
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 210 - protein, 393 aa, Homo sapiens [sequence omitted]

SEQ ID NO: 211 - protein, 3859 aa, Homo sapiens
  >TRRAP|ENSG00000196367|ENST00000359863|11580
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQGKPTWSGMHSSSIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 212 - protein, 152 aa, Homo sapiens
  >UBE2N|ENSG00000177889|ENST00000318066|459
MAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 213 - protein, 719 aa, Homo sapiens
  >UIMC1|ENSG00000087206|ENST00000377227|2160
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 214 - protein, 785 aa, Homo sapiens
  >USP1|ENSG00000162607|ENST00000339950|2358
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 215 - protein, 677 aa, Homo sapiens
  >WDR48|ENSG00000114742|ENST00000302313|2034
MAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 216 - protein, 1432 aa, Homo sapiens
  >WRN|ENSG00000165392|ENST00000298139|4299
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 217 - protein, 273 aa, Homo sapiens
  >XPA|ENSG00000136936|ENST00000375128|822
MAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKELRRAVRSSVWKRETIVHQHEYGPEENLEDDMYRKTCTMCGHELTYEKM

SEQ ID NO: 218 - protein, 633 aa, Homo sapiens
  >XRCC1|ENSG00000073050|ENST00000262887|1902
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDNMSDRVQFVITAQEWDPSFEEALMDNPSLAFVRPRWIYSCNEKQKLLPHQLYGVVPQA

SEQ ID NO: 219 - protein, 280 aa, Homo sapiens
  >XRCC2|ENSG00000196584|ENST00000359321|843
MCSAFHRAESGTELLARLEGRSSLKEIEPNLFADEDSPVHGDILEFHGPEGTGKTEMLYHLTARCILPKSEGGLEVEVLFIDTDYHFDMLRLVTILEHRLSQSSEEIIKYCLGRFFLVYCSSSTHLLLTLYSLESMFCSHPSLCLLILDSLSAFYWIDRVNGGESVNLQESTLRKCSQCLEKLVNDYRLVLFATTQTIMQKASSSSEEPSHASRRLCDVDIDYRPYLCKAWQQLVKHRMFFSKQDDSQSSNQFSLVSRCLKSNSLKKHFFIIGESGVEFC

SEQ ID NO: 220 - protein, 346 aa, Homo sapiens
  >XRCC3|ENSG00000126215|ENST00000553264|1041
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 221 - protein, 336 aa, Homo sapiens
  >XRCC4|ENSG00000152422|ENST00000511817|1011
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKENSRPDSSLPETSKKEHISAENMSLETLRNSSPEDLFDEI

SEQ ID NO: 222 - protein, 609 aa, Homo sapiens
  >XRCC6|ENSG00000196419|ENST00000359308|1830
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

The invention claimed is:

1. A method of treating a hyper-proliferative disease in a subject, comprising administering a therapeutically effective amount of 2-[(3R)-3-methylmorpholin-4-yl]-4-(1-methyl-1H-pyrazol-5-yl)-8-(1H-pyrazol-5-yl)-1,7-naphthyridine or a tautomer, an N-oxide, a hydrate, a solvate, or a pharmaceutically acceptable salt thereof to the subject, wherein said subject or the hyper-proliferative disease is characterized by one or more biomarkers, which comprises one or more deleterious mutation(s) in one or more biomarker(s), wherein the one or more biomarkers comprises BRCA1.

2. The method of claim 1, further comprising:
   a) determining if the one or more biomarkers are present in a sample of the subject;
   b) administering a therapeutically effective amount of 2-[(3R)-3-methylmorpholin-4-yl]-4-(1-methyl-1H-pyrazol-5-yl)-8-(1H-pyrazol-5-yl)-1,7-naphthyridine or a tautomer, an N-oxide, a hydrate, a solvate, or a pharmaceutically acceptable salt thereof, to the subject, if one or more of the biomarker(s) is determined to be present.

3. The method of claim 2, wherein the sample of the subject is an in vitro sample.

4. A kit comprising 2-[(3R)-3-methylmorpholin-4-yl]-4-(1-methyl-1H-pyrazol-5-yl)-8-(1H-pyrazol-5-yl)-1,7-naphthyridine or a tautomer, an N-oxide, a hydrate, a solvate, or a pharmaceutically acceptable salt together with means to detect the one or more biomarker(s) of claim 1.

5. A method for identifying a subject having a hyper-proliferative disease disposed to respond favorably to 2-[(3R)-3-methylmorpholin-4-yl]-4-(1-methyl-1H-pyrazol-5-yl)-8-(1H-pyrazol-5-yl)-1,7-naphthyridine, or a tautomer, an N-oxide, a hydrate, a solvate, or a pharmaceutically acceptable salt thereof comprising detecting the one or more biomarkers of claim 1 in a sample of the subject.

6. A method of determining whether a subject having a hyper-proliferative disease will respond to a treatment with 2-[(3R)-3-methylmorpholin-4-yl]-4-(1-methyl-1H-pyrazol-5-yl)-8-(1H-pyrazol-5-yl)-1,7-naphthyridine, or a tautomer, an N-oxide, a hydrate, a solvate, or a pharmaceutically acceptable salt thereof wherein the method comprises the detection of the one or more of the biomarker(s) of claim 1 in a sample of the subject.

* * * * *